United States Patent 11,624,072 (CANOLA WITH HIGH OLEIC ACID) - sequence listing, part 8

SEQ ID NO: 45418 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45419 - DNA, 337 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcagaactcaagaaagcaatcccaccgcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45420 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45421 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 45422 - DNA, 348 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactagacctcaagaaagcaatcccacctcactgcttcaaacgcaccatccctcgctccttctcctacctcctcttcgacatcctcgtctcctcctccctctaccacctctccacagcctacttccctctcctcccccaccctctcccttaactcgcctggcccctctactgggcctgccaaggctgcgtcctaacgggcctctgggtcatagcccacgagtgcggccaccacgccttcagcgactac

SEQ ID NO: 45423 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccacgcctggcccctctactgggcctgccaaggctgcgtcctaacgggcctctgggtcatcgcccacgaatgcggccaccacgccttcagcgactac

SEQ ID NO: 45424 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcgagacctcaagaaagcaatcccacctcactgcttcaaccgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 45425 - DNA, 280 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggccatagcccacgagtgcggccaccacgccttcagcgactac

SEQ ID NO: 45426 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccttgcgagacaccacccttcactcagacctcaagaaagcaatcccacctctctgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45427 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45428 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgcctgcagcgactac

SEQ ID NO: 45429 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 45430 - DNA, 334 bp, Artificial
  Mutation in BnaC.FAD2.b introduced by TALE nuclease pair BnFAD2_T03
caggatccatgggtgcagctggaagaatgcaagtctcccctccatccagctcccccggacccaacacccaccaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45431 - DNA, 350 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45432 - DNA, 336 bp, Artificial
  Mutation in BnaC.FAD2.b introduced by TALE nuclease pair BnFAD2_T03
caggatccatgggtgcaggtgcaagaatgcaagtgtctcctccctccaagtagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45433 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 45434 - DNA, 285 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaagaaagcaatcccacatcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 45435 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45436 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcctcttcgacatcctcgtctcctcctccctctaccacctctccacagcctacttccctctcctcccacaccctctcccttacctcgcctggcccctctactgggcctgccaaggctgcgtcctaacgggcctctgggtcatcgcccacgagtgcggccaccacgccttcagcgactac

SEQ ID NO: 45437 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45438 - DNA, 430 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggactgggcttttcgttttatctgttgtttgtcggtgaacgctctcctgagtaggacaaatccgccgggagcggatatgaacgtggagaactcaagaaagcaatcccacctcactgcttcaaacgctccatccctcgctccttctcctccctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45439 - DNA, 349 bp, Artificial
  Mutation in BnaC.FAD2.b introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45440 - DNA, 407 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactctcgacgctcaagtcagaggtggcgaaacccgacaggactataaagataccaggcgttagacctcaagaaagcaatcccacctcactgcttcaaacgctccatcccacgctccttctcctcttcgacatcatcatctcctcctcggctcctccctctaccacctctccacagcctgcttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 45441 - DNA, 266 bp, Artificial
  Mutation in BnaC.FAD2.b introduced by TALE nuclease pair BnFAD2_T03
caggatccatgggtgcaggtggaagaatgcaagtctcgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45442 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaacgggcctctgggtcatcgcccacgaatgcggccaccacgccttcagcgactac

SEQ ID NO: 45443 - DNA, 308 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaagaaagcaatcccacctcactgcttcaaacgctccatccctcgctccttctcctacctcctcttcgacatcctcatctcctcctccctctaccacctctccacatcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45444 - DNA, 346 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgacctcaagaaagcaatcccccctcactgcttcaaacgctccatccctcgctccttctcctacctcctcttcgatatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 45445 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcatacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45446 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccctctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45447 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctctgagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 45448 - DNA, 452 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtggccatcgccagcaataatggtggcaggtggtggccatcgccagcaatggcggtggcaagcaggcgctggagacggtccagcggctgttgccggtgcgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45449 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctccctccttctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 45450 - DNA, 437 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggactgggcctttcgttttatctgttgtttgtcggtgaacgctctcctgagtaggacaaatccgccgggagcggatttgaacgtggagaactcaagaaagcaatcccacctcactgcttcaaacgctccatccctcgctccttctcctacctcctcttcgacatccccgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45451 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgtgtcatagcccacgagtgcggccaccacgccttcagcgactac

SEQ ID NO: 45452 - DNA, 257 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcactctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45453 - DNA, 328 bp, Artificial
  Mutation in BnaC.FAD2.b introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgaagaaagcaatcccaccgcactgtttcaaacgctccatcccacgctccttctcctcttcgacatcatcatctcctcctcggctcctccctctaccacctctccacagccttcttccctctcccttacctcgcctgacccctctactgggcctgccaaggctgcgtcctaacgggcctctgggtcatcgcccacgaatgcggccaccacgccttcagcgactac

SEQ ID NO: 45454 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45455 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcttggtcatcgcccacgaatgcggccaccacgccttcagcgactac

SEQ ID NO: 45456 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatcgcccacgaatgcggccaccacgccttcagcgactac

SEQ ID NO: 45457 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgggcctggcacagcaccggcaacagccgctggaccgtctccagcgcctgcttgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcttctgggtcatcgcccacgaatgcggccaccacgccttcagcgactac

SEQ ID NO: 45458 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 45459 - DNA, 338 bp, Artificial
  Mutation in BnaC.FAD2.b introduced by TALE nuclease pair BnFAD2_T03
caggatccatgggtgcaggtggaagaatgcaagtctatcctccaccaacaccctcaaacgcgtcccctgcgagacaccaccattcactctcgggagacctcaagaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcccaacgggcctctgggtcatcgcccacgaatgcggccaccacgccttcagcgactac

SEQ ID NO: 45460 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccacactctcccttacctcgcctggcccctctactgggcctgccaaggctgcgtcctaacgggcctctgggtcatcgcccacgaatgcggccaccacgccttcagcgactac

SEQ ID NO: 45461 - DNA, 334 bp, Artificial
  Mutation in BnaC.FAD2.b introduced by TALE nuclease pair BnFAD2_T03
caggatccatgggtgcaggtgcaagaatgcaagtctcttctaactccagctcccccggaaccaacaccctcaaacgagtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgtgcctctgggtcatagcccacgagtgcggccaccactcctgcagcgactac

SEQ ID NO: 45462 - DNA, 426 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggaagactgagcctttcgttttatctgttgtttgtcggtgaacgctctcctgagtaggacaaatccgccgggagcggatttgaacgttgtgagacctcaagaaagcaatcccacctcattgcttcaaacgctccatcccacgctccttcccctctacgacatcatcacctcctcctcgcctcctccctctaccacctctccacagcctacttccctctcccttgccgcacctggcccctctactgggcctgccaaggctgcgtcctaacgggcctctgggtcatagcccacgagtgcggccaccgcgccttcagcgactac

SEQ ID NO: 45463 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgagacctcaagaaagcaatcccacctcactgcttcaaacgccccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccactccttcagcgactac

SEQ ID NO: 45464 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacaaatgcggccaccacgccttcagcgactac

SEQ ID NO: 45465 - DNA, 348 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcttaccctgcgagacaccgcccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45466 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 45467 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgtgacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45468 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgtgtcatagcccacgagtgcggccaccacgccttcagcgactac

SEQ ID NO: 45469 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctatccacagcctacttccctctcccttacctcgcctgacccctctactgggcctgccaaggctgcgtcctaacgggcctctgggtcatagcccacgagtgcggccaccacgccttcagcgactac

SEQ ID NO: 45470 - DNA, 309 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctccctcaccctctctcctacttcgcctggcctctctactgggcctgccagggctgcgtcctaaccggcgtctgggtcatagcccacgagtgcggccaccacgccttcagcgactac

SEQ ID NO: 45471 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctcaagaaagcaatcccacctcactgcttcaaacgctccatccctcgctccttctcctacctcctcttcgacatcatcatctcctcctcggctcctccctctaccacctctccacagcctacttccctctcccttacctcgccttacccctctactgggcctgccaaggctgcgtcctaacgggcctctgggtcatagcccacgagtgcggccaccacgccttcagcgactac

SEQ ID NO: 45472 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaagggtgcgtcctaaccggcgtctgggtcatagcccacgagtgcggccaccacgccttcagcgactac

SEQ ID NO: 45473 - DNA, 349 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaaccctcaaacgcgtcccctgcgagacaccacccttcactctcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45474 - DNA, 339 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcaagaaagcaatcccacctcactgcttcaaacgctccatcccacgctccttctcctcttcgacatcatcatctcctcctcggctcctccctctaccacctctccccagcctacttccctctcctcccccaccctctcccttacctcgcctggcccctctactgggcctgccaaggctgcgtcctaacgggcctcggggtcatagcccacgagtgcggccaccacgccttcagcgactac

SEQ ID NO: 45475 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatttcggagacctcaagaaagcaatcccacctcactgcttcaaacgctccatccctcgctccttctcctaccttctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45476 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45477 - DNA, 332 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaaacgtgtcccctgcgagacaccaccattcaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45478 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgcgtcatagcccacgagtgcggccaccacgccttcagcgactac

SEQ ID NO: 45479 - DNA, 392 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacgctcaagtcagaggtggcgaaacccgacaggactataaagataccaggcgttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45480 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgcgacctcaagaaagcaatcccacctcactgcttcaaacgctccaccccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45481 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcggcgtcctaacgggcctctgggtcatagcccacgagtgcggccaccacgccttcagcgactac

SEQ ID NO: 45482 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaacacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45483 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45484 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45485 - DNA, 350 bp, Artificial
  Mutation in BnaC.FAD2.b introduced by TALE nuclease pair BnFAD2_T03
caggatccatgggtgcaggtggaagaatgcaagtctctactcactccagctcccccgaaaccaaaaccctcgaacgcgtcccctgcgagacaccacccttcactctaaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 45486 - DNA, 334 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45487 - DNA, 349 bp, Artificial
  Mutation in BnaC.FAD2.b introduced by TALE nuclease pair BnFAD2_T03
caggatccatgtgtgcaggtggaagaatgcaagtgtctcctccctccaaaaagtctgaaaccgacaccatcaagcgcgtaccctgcgagacaccgcccttcactaagaactcaataaagaaatccaacccccctgcttcaaacgaaccctccctcgctccctctcctacctactcttcgccatccttgcctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45488 - DNA, 316 bp, Artificial
  Mutation in BnaC.FAD2.b introduced by TALE nuclease pair BnFAD2_T03
caggatccatgggtgcaggtggaagaatgcaagtctgtactccctccagctcccccggaaccaacaccctcaaactcctccctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 45489 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgccttcagcgactac

SEQ ID NO: 45490 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggcacagcaccggcaacagccgctggaccgtcaggatggccttctgcttagtttgatgcctggcagtttatggcgggcaggaaccccaagaaaacaatcccacctcactgcttcaaacgctccatcccacgctccttctcctcttcgacatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45491 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcccttacctcgcctgaccccactactgggcctgccaaggctgcgtcctaacgggcctctgggtcatagcccacgagtgcggccaccacgccttcagcgactac

SEQ ID NO: 45492 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 45493 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45494 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccgcctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45495 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45496 - DNA, 419 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctctccagcgcctgcttgccggtgctgtgccaggcccacggcttgaccccccagcaggtgttggccatcgccagcaataatggggagacctcaagaaagcaatcccacctcactgcttcaaacgctccatcccacgctccttctcctcttcgacatcatcatcccctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45497 - DNA, 349 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgtaccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccccggcccctctactgggcctgccaatgctgcgtcctaacgggcctctgggtcatagcccacgagtgcggccaccacgccttcagcgactac

SEQ ID NO: 45498 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacccccaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccactccttcagcgactac

SEQ ID NO: 45499 - DNA, 342 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45500 - DNA, 317 bp, Artificial
  Mutation in BnaC.FAD2.b introduced by TALE nuclease pair BnFAD2_T03
caggatccatgggtgcaggtggaagaatgcaagtctctcctccctcaagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45501 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45502 - DNA, 279 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgctgcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45503 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccagacctcaagaaagcaatcccacctcactgcttcaaacgctccatccctcgctccttctcctacctcctcttcgacatcctcgtctcctcctccctctaccacctctccacaccctacttccctctcctccaccaccctctcccttacctcgcctggcccctctactgggcctgccaaggctgcgtcctaacgtgcctctgggtcatcgcccacgaatgcggccaccacgccttcagcgactac

SEQ ID NO: 45504 - DNA, 401 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctcaactatcgtcttgagtccaacccggtaagacacgacttatcgccactggcagcagccactggtaagacctcaagaaagcaatcccacctcactgcttcaaacgctccatcccacgctccttctcctcttcgacatcatcatctcctcctcggctcctccctctaccacctctccacagcctacttccctctcccttacctcgactggcccctctactgggcctgccaaggctgcgtcctaacgggcctctgggtcatcgcccacgaatgcggccaccacgccttcagcgactac

SEQ ID NO: 45505 - DNA, 351 bp, Artificial
  Mutation in BnaC.FAD2.b introduced by TALE nuclease pair BnFAD2_T03
caggatccatgggtgcaggtggaagaatgcaagtgtctactccctccaagaagtctgaaaccgacaccatcaagcgcgtaccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggcggcgtcctaacctgcgtctgggtcatagcccacgagtgcggccaccacgccttcagcgactac

SEQ ID NO: 45506 - DNA, 383 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagcaggtggtggccatcgccagccacgatggcggcaagcaggcgctggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45507 - DNA, 281 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45508 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaacgggcctctgggtcatagcccacgagtgcggccaccacgccttcagcgactac

SEQ ID NO: 45509 - DNA, 417 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccggagcaggtggtggccatcgccagccacgatggcggcaagagacctcaagaaagcaatcccacctcactgcttcaaacgctccatcccacgctccttctcctcttcgacaccatcatctcctcctcggctcctccctctaccacctctccacagcctccttccctctcccttccctcgcctgacccctctactgggcctgccaaggctgcgtcctaacgggcctctgggtcatagcccacgagtgcggccaccacgccttcagcgactac

SEQ ID NO: 45510 - DNA, 281 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45511 - DNA, 309 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45512 - DNA, 338 bp, Artificial
  Mutation in BnaC.FAD2.b introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactaaaacaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45513 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccatctactgggcctgccaaggctgcgtcctaacgggcctctgggtcatcgcccacgaatgcggccaccacgccttcagcgactac

SEQ ID NO: 45514 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcctacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45515 - DNA, 316 bp, Artificial
  Mutation in BnaC.FAD2.b introduced by TALE nuclease pair BnFAD2_T03
aggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45516 - DNA, 432 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcctggagacggtccagcggctgttgccggtgctgtgccaggcccacggcttgaccccggagcaggtggtggccatcgccagccacgatggcggagacctcaagaaagcaatcccacctcactgcttcaaacgctccatcccccgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45517 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctcaagaaagcaatcccacctcactgcttcaaacgctccatcccacgctccttctcctcttcgacatcatcatctcctcctcggctcctccctctaccacctctccacagcctacttccctctccattacctcgcctgacccctctactgggcctgccaaggctgcgtcctaacgggcctctgggtcatagcccacgagtgcggccaccacgccttcagcgactac

SEQ ID NO: 45518 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgccatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45519 - DNA, 415 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatgggcaggttgtagccgccggagtaggccttggtgtccacgatcacgccgtagtcgatggggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 45520 - DNA, 411 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagcaggtggtggccatcgccagcaatattggtggcaagcaggcgctggagacggtgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcaactac

SEQ ID NO: 45521 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45522 - DNA, 331 bp, Artificial
  Mutation in BnaC.FAD2.b introduced by TALE nuclease pair BnFAD2_T03
caggatccatgggtgcaggtggaagaatgcaagtgtctactacctccagctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45523 - DNA, 349 bp, Artificial
  Mutation in BnaC.FAD2.b introduced by TALE nuclease pair BnFAD2_T03
caggatccatgggtgcaggtggaagaatgcaaggctctcctccctccagctcccccgaaaccaaaaccctcaaacgcgtcccctgcgagacaccacccttcactcagacctcaagaaagcaatcccacctcactgcttcaaacgccccatccctcgctccttctcctacctcctcttcgacatcctcgtctcctcctccctctaccacctctccacagcctacttccctctcctcccccaccctcgcccttacctcccctggcccctctactgggcctgccaaggctgcgtcctaacgggcctctgggtcatcgcccacgaatgcggccaccacgccttcagcgactac

SEQ ID NO: 45524 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 45525 - DNA, 358 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45526 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctccaccaccctctcccttacctcgcctggcccctctactgggcctgccaaggctgcgtcctaacgggcctctgggtcatcgcccacgaatgcggccaccacgccttcagcgactac

SEQ ID NO: 45527 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45528 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 45529 - DNA, 334 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcccgacccctctactgggcctgccaaggctgcgtcctaacgggcctctgggtcatagcccacgagtgcggccaccacgccttcagcgactac

SEQ ID NO: 45530 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgaaagcaatcccacctcactgcttcaaacgctccatccctcgctccttcccctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45531 - DNA, 376 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccaccattcactctctccagcgcctgcttgccaccgccattgctggcggtggccagacctcaagaaagcaatcccacctcactgcttcaaacgccccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45532 - DNA, 312 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45533 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45534 - DNA, 349 bp, Artificial
  Mutation in BnaC.FAD2.b introduced by TALE nuclease pair BnFAD2_T03
caggatccatgggtgcaggtggaataatgcaagtctctcctctcttcagctcccccgaaaccaaaaccctcaaacgcgtcccctgtgagacaccacccttcactcagacctcaagaaagcaatcccacctcactgcttcatacgctccatccctcgcaccttctcctacctcctcttcgacatcctcgtctcctcctccctccaccacctctccactgcctacttccctctcctcccccacccgctcccttaccgcgcctggcccctctactgggcctgccaaggctgcgtcctaacgggcctctgggtcatagcccacgagtgcggccaccacgccttgagcgactgc

SEQ ID NO: 45535 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45536 - DNA, 343 bp, Artificial
  Mutation in BnaC.FAD2.b introduced by TALE nuclease pair BnFAD2_T03
caggatccatgggtgcaggtggaagaatgcaagtgtctcctcactccagctcccccggaaccaacaacctcaaacgcgtcccctgcgagacaccaccattcacctgagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45537 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgtcaaggctgcgtcctaacgggcctctgggtcatcgcccacgaatgcggccaccacgccttcagcgactac

SEQ ID NO: 45538 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgagacctcaagaaagcaatcccacctcactgcttcaagcgctccatccctcgctccttctcctacctcctcttcgacatcctcgtctcctcctccctctaccacctctccacagcctacttccctctcccttacctcgcctgacccctctactggtcctgccaaggctgcgtcctaacgggcctctgggtcatagcccacgagtgcggccaccacgccttcagcgactac

SEQ ID NO: 45539 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgtgacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatagcccacgagtgcggccaccacgccttcagcgactac

SEQ ID NO: 45540 - DNA, 350 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 45541 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccacctcactgcttcaaacgctccatcccacgctccttctcctcttcgacatcatcatctcctcctcggctcctccctctaccacctctccgcagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45542 - DNA, 400 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagacggtccagcggctgttgccggtgctgtgccaggcccacggtccagcggctgttgccggagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45543 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagacctcaagaaagcaatcccacctcactgcttcaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45544 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 45545 - DNA, 331 bp, Artificial
  Mutation in BnaC.FAD2.b introduced by TALE nuclease pair BnFAD2_T03
caggatccatgggtgcaggtggaagaatgcaagtctctcctcccttcagctcccccgaaaccaaaaccctcaaacgcgtcccctgcgagacaccacccttcactcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45546 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcggcgtcctaacgggcctcggggtcatagcccacgagtgcggccaccacgccttcagcgactac

SEQ ID NO: 45547 - DNA, 349 bp, Artificial
  Mutation in BnaC.FAD2.b introduced by TALE nuclease pair BnFAD2_T03
caggatccatgggtgcaggtggaagaatgtaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45548 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcggcgtcctaacgtgcctctgggtcatagcccacgtgggcggccaccgcgccttcagcgactac

SEQ ID NO: 45549 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45550 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 45551 - DNA, 352 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaagcgcgtaccctgcgagccaccacccttcactccttagacctcaagaaagcaatcccacctcactgcttcaaacgctccatccctcgctccttctcctacctcctcttcgacctcctcgtctccccctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45552 - DNA, 335 bp, Artificial
  Mutation in BnaC.FAD2.b introduced by TALE nuclease pair BnFAD2_T03
caggaccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45553 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 45554 - DNA, 336 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactcatgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45555 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatccctcgctccttctcctccctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45556 - DNA, 415 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcgccagccacgatggcggcaagcaggcgctggagacggtccagcggctgttgccggtgctgtgccagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45557 - DNA, 337 bp, Artificial
  Mutation in BnaC.FAD2.b introduced by TALE nuclease pair BnFAD2_T03
caggatccatgggtgcaggtggaagaatgcaagtgtctcctccatccaagaagtctgaaaccgacaccatcaagcgcgtaccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45558 - DNA, 433 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggataaaattgtagctgggtgcaaaatagcaactaatcttgatttaaggcttcaaaacctcccgcaagtcgggaggttcggagacctcaagaaagcaatcccacctcactgcttcaaacgctccatccctcgctccttctcctacctcccctccgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45559 - DNA, 349 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctggcccctctactgggcctgccaaggctgcgtcctaacgggcctctgggtcatcgcccacgaatgcggccaccacgccttcagcgactc

SEQ ID NO: 45560 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctacggggcgtgccaaggcggcgccctaacggccctctgggccatcccccccaaatccggcccccacgccttcggcaactcc

SEQ ID NO: 45561 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccatgagtgcggccaccacgccttcagcgactac

SEQ ID NO: 45562 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagaaagcaatcccacctcactgcttcaaacgctccatcccacgctccttctcctcttcgccatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45563 - DNA, 344 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45564 - DNA, 395 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagcgttcaccgacaaacaacagataaaacgaaaggcccagtcacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45565 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccatcccacgcgccttctcaagaaagcaatcccacctcactgcttcaaacgctccatcccacgctccttctcctcttcgacatcatcatctcctcctcgactcctccctctcccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45566 - DNA, 319 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 45567 - DNA, 334 bp, Artificial
  Mutation in BnaC.FAD2.b introduced by TALE nuclease pair BnFAD2_T03
caggatccatgggtgcaggtggaagaatgcaagtttctcctccctccagctcccccgaaaccaaaaccctcaaacgcgtcccctgcgagacaccacccttcactcgacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccaccagggcggccaccacgccttcagcgactac

SEQ ID NO: 45568 - DNA, 396 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattgagcggatttgtcctactcaggagagcgttcaccgacaaacaacagataaaacgaaaggcccagtcttccctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45569 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaattccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 45570 - DNA, 347 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcacctcaagaaagcaatcccacctcactgcttcaaacgctcaatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatcgcccacgaatgcggccaccgcgccttcagcgactac

SEQ ID NO: 45571 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatccaacctcactgcttcaaacgctccatcccacgctccttctcctcttcgacatcatcatctcctcctcggctcctcccccaccctctcccttacctcgcctggcccctctactgggcctgccaaggctgcgtcctaacgggcctctgggtcatcgcccacgaatgcggccaccacgccttcagcgactac

SEQ ID NO: 45572 - DNA, 369 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcccacggcttgaccccggagcaggtggtggccatcgcctggcacgatggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 45573 - DNA, 405 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttggggggtcaagccgtgggcctggcacagcaccggcaacagccgctggaccgtctccagcgcctgcttgagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45574 - DNA, 349 bp, Artificial
  Mutation in BnaC.FAD2.b introduced by TALE nuclease pair BnFAD2_T03
caggatccatgggtgcaggtggaagaatgcaagtgtctcctctctccaagaagtctgaaaccgacaccatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcataacgggcctctgggtcatagcccacgagtgcggccaccacgccttcagcgactac

SEQ ID NO: 45575 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45576 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcacttcactgtcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45577 - DNA, 335 bp, Artificial
  Mutation in BnaC.FAD2.b introduced by TALE nuclease pair BnFAD2_T03
caggatccatgggtgcaggtggaagaatgcaagtctctcccccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45578 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaagggtgcgtcctaacgggcctctgggtcatcgcccacgaatgcggccaccacgccttcagcgactac

SEQ ID NO: 45579 - DNA, 381 bp, Artificial
  Mutation in BnaC.FAD2.b introduced by TALE nuclease pair BnFAD2_T03
caggatccatgggtgcaggtggaagaatgcaagtctcacctccctccagctcccccggaaccaacaccctcaaacgcgtcccctgcgagacaccaccattcactctcggagagcgttcaccgacaaacaacagataaaacgaaaggcccagtcacctcaagaaagcaatcccacctcactgcttcaaacgctccatcccacgctccttctcctcttcgacatcatcatctcctcctcggctcctccctctaccacctcgccacagcctacttccctctcccttacctcgcctgacccctctactgggcctgccaaggctgcgtcctaacgggcctctgggtcatcgcccacgaatgcggccaccacgccttcagcgactac

SEQ ID NO: 45580 - DNA, 274 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45581 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttcactgcttcaaacgctccatccctcgctccttctcctcttcggcatcatcatctcctcctcggctcctccctctaccacctctccacagcctacttccctctcccttacctcgcctgacccctctactgggcctgccaaggctgcgtcctaacgggcctctgggtcatagcgcacgagggcggccaccgcgccttcagcgactgc

SEQ ID NO: 45582 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgtgcctctgggtcatagcccacgagtgcggccaccacgccttcagcgactac

SEQ ID NO: 45583 - DNA, 340 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45584 - DNA, 337 bp, Artificial
  Mutation in BnaC.FAD2.b introduced by TALE nuclease pair BnFAD2_T03
caggatccatggggtgcaggtggaagaatgcaagtctctcctccctccagctcccccgaaaccaaaaccctcaaacgcgtcccctgcgagacaccacccttcacctcaagaaagcaatcccacctcactgcttcaaacgctccatcccacgctccttctcctcttcgacatcatcatctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 45585 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcacgtaccctgcgagacaccgcccttcactgactcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45586 - DNA, 336 bp, Artificial
  Mutation in BnaC.FAD2.b introduced by TALE nuclease pair BnFAD2_T03
caggatccatgggtgcaggtggaagaatgcaagtctctcctgcctccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctaccgggcctgccaaggctgcgtgctaacgggcctctgggtcatagcccacgagtgcggccaccacgccttcagcgactac

SEQ ID NO: 45587 - DNA, 344 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45588 - DNA, 335 bp, Artificial
  Mutation in BnaC.FAD2.b introduced by TALE nuclease pair BnFAD2_T03
cggatccatgggtgcaggtggaagaatgcaagtctctcctccctccagctcccccggaaccaacaccctcaaacgcgtcccctgcgagcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 45589 - DNA, 289 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgcttgatccctcgctctttctcctacctcctcttcgacatcctcgtctcctcctccctctaccacctctccacagcctacttccctctcccttacctcgcctgacccctctactgggcctgccaaggctgcgtcctaacgggcctcttggtcatcgcccacgaatgcggccaccacgccttcagcgactac

SEQ ID NO: 45590 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45591 - DNA, 393 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatctcctcctcggctcctccctctaccacctctccacagcctacttccctctcctcccccaccctctctcctacttcgcctggcctctctactgggcctgccagggctgcgtcctaacgggcctctgggtcatagcccacgagtgcggccaccacgccttcagcgactac

SEQ ID NO: 45592 - DNA, 397 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaggtcttgaccccggagcaggtggtggccatcgccagccacgatggcggcaagcaggcgctggagaagaactcaagaaagcaatcccacctcactgcttcaaacgctccatcccacgctccttctcctcttcgacatcatcatctcctcctcggctcctccctctcccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45593 - DNA, 274 bp, Artificial
  Mutation in BnaC.FAD2.b introduced by TALE nuclease pair BnFAD2_T03
caggatccatgggtgcaggtggaagaatggaagtctctcctccctccagctcccccggaaccaacacctcactgcttcaaacgatccatcccacgctccttctcctcttcgacatcatcatctcctcctcggctcctccctctagcacctctccacagcctacttccctctcccttacctcgcctgacccctctactgggtctgccaatgctgcgtcctaacgggcctctgggtcatagcccacgagtgcggccaccacgccttcagcgactac

SEQ ID NO: 45594 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 45595 - DNA, 366 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactatcaggggataacgcaggaaagaacatgtgagcaaaaggccagcaaatctaccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45596 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctagcccctctactgggcctgccaaggctgcgtcctaacgggcctctgggtcatcgcccacgaatgcggccaccacgccttcagcgactac

SEQ ID NO: 45597 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcacacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45598 - DNA, 288 bp, Artificial
  Mutation in BnaC.FAD2.b introduced by TALE nuclease pair BnFAD2_T03
caggatccatgggtgcaggtggaagaatgcaagtctctcctccctccaggtagacctcaagaaagcaatcccacctcactgcttcaaacgctccatccctcgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45599 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 45600 - DNA, 349 bp, Artificial
  Mutation in BnaC.FAD2.b introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45601 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgtccaccacgccttcagcgactac

SEQ ID NO: 45602 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaaggctgcgtcctaacgggcctctgggtcatagcccacgagtgcggccaccacgccttcagcgactac

SEQ ID NO: 45603 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 45604 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcctctgggtcatagcccacgagtgcggccaccacgccttcagcgactac

SEQ ID NO: 45605 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcggagacctcaagaaagcaatcccacctcactgcttcaaacgctccacccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 45606 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccatcggagacctcaagaaagcaatcccacctcactgcttcaaacgctccatcccacgctccttctcctcttctacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45607 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45608 - DNA, 333 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctcctcaagaaaacaatcccacctcactgcttcaaacgctccatccctcgctccttctcctcttcgccatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45609 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaatcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45610 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccagaacgggtagtgaattgcgcttgagatggtttaatttcaactttaatcattattgaattccctcgggtttcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45611 - DNA, 351 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45612 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 45613 - DNA, 322 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45614 - DNA, 317 bp, Artificial
  Mutation in BnaC.FAD2.b introduced by TALE nuclease pair BnFAD2_T03
caggatccatgggtgcaggtggaagaatgcaagtctcaactccctcaagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttcactctcccttacctcgcctgacccctctactgggcctgccaaggctgcgtcctaacgggcctctgggtcatagcccacgagtgcggccaccacgccttcagcgactac

SEQ ID NO: 45615 - DNA, 349 bp, Artificial
  Mutation in BnaC.FAD2.b introduced by TALE nuclease pair BnFAD2_T03
aggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45616 - DNA, 427 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgggctcccccatcgactacggcgtgatcgtggacaccaaggcctactccggcggctacgctatggaactcgccgcccgactgggctggcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45617 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45618 - DNA, 315 bp, Artificial
  Mutation in BnaC.FAD2.b introduced by TALE nuclease pair BnFAD2_T03
caggatccatgggtgcaggtgaagaatgcaagtctctcctccctccagctcccccgaaaccaaaaccctcaaacgcgtcccctgtagacctcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45619 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatcccaccctccttctcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45620 - DNA, 381 bp, Artificial
  Mutation in BnaC.FAD2.b introduced by TALE nuclease pair BnFAD2_T03
caggatccatgggtgcaggtggaagaatgcaagtgtctcccccctccaaaaagtctgaaaccgacaacatcaagcgcgtaccctgcgagacaccgcccttcactgtcgatggccaccacctgctccggggtcaagccgaactcaagaaagcaatcccacctcactgcttcaaacgctccatcccccgctccttctcctcttcgacatcatcatctcctcctcggctcctccctctaccacctctccacagcctacttccctctcctcccccaccccctcccttacctcgcctggcccctctactgggcctgccaaggctgcgtcctaacgggcctctgggtcatcgcccacgaatgcggccaccacgccttcagcgactac

SEQ ID NO: 45621 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcagcgcccacgaatgcggccaccactccttcagcgactac

SEQ ID NO: 45622 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatccctcgctccttctcctacctcctcttcgacatcctcgtctcctcctccctctaccacctctccacagcctacttccatctcctcccccaccctctcccttacctcgcctggcccctctactgggcctgccaaggctgcgtcctaacgggcctctgggtcatcgcccacgaatgcggccaccacgccttcagcgactac

SEQ ID NO: 45623 - DNA, 315 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45624 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgagacctcaagaaagcaatcccacctcactgcttcaaccgctccatccctcgctccttctcctacctcctcttcgacatcctcgtctcctcctccctctaacacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45625 - DNA, 401 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccatgcgagacaccaccattcactcttgaccccggagcaggtggtggccatcgccagccacgatggcggcaagcaggcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 45626 - DNA, 356 bp, Artificial
  Mutation in BnaC.FAD2.b introduced by TALE nuclease pair BnFAD2_T03
caggatccatgggtgcaggtggaagaatgtaagtctctcctccctccagctcccccgaaaccaaaaccctcaaacgcgtcccctgcgagacaccacccttcactctcggagaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45627 - DNA, 351 bp, Artificial
  Mutation in BnaC.FAD2.b introduced by TALE nuclease pair BnFAD2_T03
caggatccatgggtgcagggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctccttctcctacctcatctgggacatcatcatagcctcccgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 45628 - DNA, 419 bp, Artificial
  Mutation in BnaC.FAD2.b introduced by TALE nuclease pair BnFAD2_T03
caggatccatgggtgcatgtggaagaatgcaagtctctcccccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctcgtcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45629 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatcccacgctccttctcctcttcgacatcatcatctcctcctcggctcctccctctaccacctctccacagcctacttccctctctcctacttcgcctggcccctctactgggcctgccaaggctgcgtcctaacgggcctctgggtcatcgcccacgaatgcggccaccacgccttcagcgactac

SEQ ID NO: 45630 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcaagaaagcaatcccacctcactgcttcaaacgctccaaccctcgctccttctcctacctcctcttcgacatcctcgtctcctcctccctctaccacctctccacagcctacttccctctcctccccccccctctcccttacctcgcctggcccctctactgggcctgccaaggctgcgtcctaacgggcctctgggtcatcgcccacgaatgcggccaccacgccttcagcgactac

SEQ ID NO: 45631 - DNA, 405 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctccgagacaccacccttcactccggtccagcggctgttgccgccatcgtggctggcgatggccaccacctgctccggggtcaagccgtgggcagacctcaagaaagcaatcccacctcactgcttcaaacgctccatcccacgctccttctcctcttcgacatcatcatctcctcctcggctcctccctctaccacctctccacagcctacttccctctcccttacctcgccggacccctctactgggcctgccaaggctgcgtcctaacgggcctctgggtcatagcccacgagtgcggccaccacgccttcagcgactac

SEQ ID NO: 45632 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45633 - DNA, 350 bp, Artificial
  Mutation in BnaC.FAD2.b introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45634 - DNA, 351 bp, Artificial
  Mutation in BnaC.FAD2.b introduced by TALE nuclease pair BnFAD2_T03
caggatccatgggtgcaggtggaagaatgcaagtgtctgctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacaccctacttccctctcctccccctccccctcccttacctcgcctggcccctctactgggcgtgccaaggcggcgttctaacgggcctctggttcatcgcccacgaatgcggccaccacgccttcagcgactac

SEQ ID NO: 45635 - DNA, 329 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgacgac

SEQ ID NO: 45636 - DNA, 293 bp, Artificial
  Mutation in BnaC.FAD2.b introduced by TALE nuclease pair BnFAD2_T03
caggatccatgggtgcaggtggaagaatgcaagtctctcctccctccagctcccccggaaccaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 45637 - DNA, 290 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcaatcccaccgcactgtttcaaacgcttgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccactccttcagcgactac

SEQ ID NO: 45638 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactcccagacctcaagaaagcaatcccacctcactgcttcaaacgctccaccccacgctccttctcctctccgacatcatcacctcctcctcggctcctccccctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45639 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgcctgcagcgactac

SEQ ID NO: 45640 - DNA, 356 bp, Artificial
  Mutation in BnaC.FAD2.b introduced by TALE nuclease pair BnFAD2_T03
caggatccatgggtgcaggtggaagaatgcaagtgtctactaactacaagaagtctgaaaccgacaccatcaagcgcgtaccctgcgagacaccgcccttcactgtcgtggagaactcaagaaagcaatcccaccgcactgtttcaaactctccatcccacgctccttctcctcttcgacatcatcatctcctcctcggctcctccctctaccacctctccccagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45641 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 45642 - DNA, 349 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgagtgcggccaccacgccttcagcgactac

SEQ ID NO: 45643 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccctccgagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgtcaaggctgcgtcctaacgggcctctgggtcatagcccacgagtgcggccaccacgccttcagcgactac

SEQ ID NO: 45644 - DNA, 279 bp, Artificial
  Mutation in BnaC.FAD2.b introduced by TALE nuclease pair BnFAD2_T03
caggatccatgggtgcaggtggaagaatgcaagtgtctcctccctccagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45645 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccaagcctcagcgactac

SEQ ID NO: 45646 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctcccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45647 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45648 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 45649 - DNA, 337 bp, Artificial
  Mutation in BnaC.FAD2.b introduced by TALE nuclease pair BnFAD2_T03
caggatccattggtgcaggtggaagaatgcaagtctctcctcactccagctcccccggaaccaacaccctcaaacgcttcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgcctgcagcgactac

SEQ ID NO: 45650 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctggcccctctactgggcctgccaaggctgcgtcctaacgggcctctgggtcatcgcccacgaatgcggccaccacgccttcagcgactac

SEQ ID NO: 45651 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtaatagcccacgagtgcggccaccacgccttcagcgactac

SEQ ID NO: 45652 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45653 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacacctccattcactcttacctcaagaaagcaatcccacctcactgcttcaaacgctccatcccacgctccttctcctcttcgacatcatcatctcctcctcggcccctccctctaccacctctccacagcctacttccctctcccttacctcgcctgacccctctactgggcctgccagggctgcgtcctaacgggcctctgggtcatcgcccacgaatgcggccaccacgccttcagcgactac

SEQ ID NO: 45654 - DNA, 349 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45655 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 45656 - DNA, 301 bp, Artificial
  Mutation in BnaC.FAD2.b introduced by TALE nuclease pair BnFAD2_T03
caggatccatgggtgcaggtggaagaatgcaagtctctcctccctcccgtccccccggaaacaacaccctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccatcagcgactac

SEQ ID NO: 45657 - DNA, 306 bp, Artificial
  Mutation in BnaC.FAD2.b introduced by TALE nuclease pair BnFAD2_T03
caggatccatgggtgcaggtggaagaatgcaagtctctcctcactccagctcccccgaaaccaaaacccccaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcggcctaacgggcctctgggtcatagcccacgagtgcggccaccacgccttcagcgactac

SEQ ID NO: 45658 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactatcccacctcactgcttcaaacgctccatccctcgctccttctcctacctcctcttcgacatcctcggctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45659 - DNA, 322 bp, Artificial
  Mutation in BnaC.FAD2.b introduced by TALE nuclease pair BnFAD2_T03
caggatccatgggtgcaggtggaagaatgcaagtctatactccctccagctcccccgaaaccaaaaccctcaaacgagtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 45660 - DNA, 336 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45661 - DNA, 351 bp, Artificial
  Mutation in BnaC.FAD2.b introduced by TALE nuclease pair BnFAD2_T03
caggatccatgggtgcaggtggaagaatgcaagtgtatactccctccaagaagtctgaaaccgacaccatcaagcgcgtaccctgcgagacaccgcccttcactgtagaaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttccctcgcctggcctctctactgggcctgccaagactgcgtcctgacgggcctctgggtcatcgcccacgaatgcgtccaccacgccttcagcgactac

SEQ ID NO: 45662 - DNA, 315 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcactctgagacctcaagaaagcaatcccacctcactgcttcaaacgctccatcccacgctccttctcctcttcgacatcatcatctcctcctcggctcctcccccaccctctcccttacctcgcctgacccctctactgggcctgccaaggctgcgtcctaacgggcctctgggtcatcgcccacgaatgcggccaccacgccttcagcgactac

SEQ ID NO: 45663 - DNA, 319 bp, Artificial
  Mutation in BnaC.FAD2.b introduced by TALE nuclease pair BnFAD2_T03
caggatccatgggtgcaggtggaagaatgcaagtctctcccccctcaagctcccccggaaccaacaccctcaaacgcgtcccctgccagacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcgtccaccacgccttcagcgactac

SEQ ID NO: 45664 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 45665 - DNA, 427 bp, Artificial
  Mutation in BnaC.FAD2.b introduced by TALE nuclease pair BnFAD2_T03
caggatccatgggtgcaggtggaagaatgcaagtctctcctcactccaagaagtctgaaaccgacaccatcaagcgcgtaccctgcgagacaccaccattcactcacagcaccggcaacagccgctggaccgtctccagcgcctgcttgccaccgccaagccgtgggcctggcacagcaccggcaacagccgctggacgacctcaagaaagcaatcccacctcactgcttcaaacgctccatcccacgctccttctcctcttcgacatcatcatctcctcctcggctcctccctctaccacctctccacagccttcttccctctcccttacctcgcctgacccctctactgggcctgccaaggctgcgtcctaacgggcctctgggtcatctcccacgaatgcggccaccacgccttcagcgactac

SEQ ID NO: 45666 - DNA, 295 bp, Artificial
  Mutation in BnaC.FAD2.b introduced by TALE nuclease pair BnFAD2_T03
caggatccatgggtgcaggtggaagaatgcaagtctctcatccctccaggtagacctcaagaaagcaatcccacctcactgcttcaaacgctccatccctcgctccttctcctacctcctcttcgacatcctcgtctcctcctccctctaccacctctccacagcctacttccctctcctccctcagcctctcccttacctcgcctggcccctctactgggcctgccaaggctgcgtcctaacgggcctctgggtcatagcccacgagtgcggccaccacgccttcagcgactac

SEQ ID NO: 45667 - DNA, 348 bp, Artificial
  Mutation in BnaC.FAD2.b introduced by TALE nuclease pair BnFAD2_T03
caggatccatgggtgcaggtggaagaatgcaagtctatacacactccagctcccccgaaaccaaaaccctcaaacgcgtcccctgcgagacaccacccttcactcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgtccaccacgcctgcagcgactac

SEQ ID NO: 45668 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctggcgatggccaccaccattcactcggggggtcaagccgtgggcctggcacagcaccggcaacagccgcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45669 - DNA, 349 bp, Artificial
  Mutation in BnaC.FAD2.b introduced by TALE nuclease pair BnFAD2_T03
caggatccatgggtgcaggtggaagaatgcaagtctctactccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45670 - DNA, 306 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaactcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgtgtcctaaccggcgtctgggtcatagcccacgagtgcggccaccacgccttcagcgactac

SEQ ID NO: 45671 - DNA, 328 bp, Artificial
  Mutation in BnaC.FAD2.b introduced by TALE nuclease pair BnFAD2_T03
caggatccatgggtgcaggtggaagaatgcaagtatcacctcccttaagctcccccgaaaccaaaaccctcaaacgcgtcccctgcgagacaccacccttcactcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctccgtcctaacgtgcctctgggtcatagctcacgagtgcggccaccacgccttgagcgactac

SEQ ID NO: 45672 - DNA, 316 bp, Artificial
  Mutation in BnaC.FAD2.b introduced by TALE nuclease pair BnFAD2_T03
caggatccatgggtgcaggtggaagaatgcaagtctctcctccctccagctccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaagggtgcgtcctaaccggcgtctgggtcatagcccacgagtgcggccaccacgccttcagcgactac

SEQ ID NO: 45673 - DNA, 335 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45674 - DNA, 345 bp, Artificial
  Mutation in BnaC.FAD2.b introduced by TALE nuclease pair BnFAD2_T03
caggatccatgggtgcaggtggaagaatgcaagtctctcctccctccagctccccgaaaccaaaaccctcaaacgcgtcccctgcgagacaccacccttcactctgtcaagaaagcaatcccacctcactgcttcaaacgctccatccctcgctccttctcctacctcctcttcgacatcctcgtctcctcctccctctaccacctctccacagcctactcccctctcctcccccgccctctcccttacctcgcctggcccctctactgggcctgccaaggctgcgtcctaacgggcctctgggtcatcgcgcacgaatgcggccaccacgccttcagcgactac

SEQ ID NO: 45675 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctctcttacctcgcctgacccctctactgggcctgccaaggctgcgtcctaacgggcctctgggtcatagcccacgagtgcggccaccacgccttcagcgactac

SEQ ID NO: 45676 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgccccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45677 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagagacctcaagaaagcaatcccacctcactgcttcaaacgctccattcctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45678 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctaccgggcctgccaaggctgcgtcctaacgggcctctgggtcatagcccacgagtgcggccaccacgccttcagcgactac

SEQ ID NO: 45679 - DNA, 338 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45680 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctacaacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45681 - DNA, 346 bp, Artificial
  Mutation in BnaC.FAD2.b introduced by TALE nuclease pair BnFAD2_T03
caggatccatgggtgcaggtggaagaatgcaagtctctccaccctccagctcccccgaaaccaaaaccctcaaacgcgtcccctgcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45682 - DNA, 334 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctcagcgactac

SEQ ID NO: 45683 - DNA, 381 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactcgggtcaagccgtgggcctggcacagcaccggcaagcaggcgctggagagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45684 - DNA, 434 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcgcctgcttgccgccatcgtggctggcgatggccaccacctgctccggggtcaagccgtgggcctggcacagcaccggcaacagccgctggacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45685 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactcc

SEQ ID NO: 45686 - DNA, 336 bp, Artificial
  Mutation in BnaC.FAD2.b introduced by TALE nuclease pair BnFAD2_T03
caggatccatgggtgcaggtggaagaatgcaagtatctactccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45687 - DNA, 389 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccaccattcactactgacagaaccgcaacgttgaaggagccactcagccgcgggtttctgagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45688 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45689 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45690 - DNA, 370 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaccagcggctgttgccggtcctgggaagccgaagttaccaaaaggtcgttgatcaaacctcaagaaatcaatcccacctcacttcttcaaacgctccatccctcactccttctcctacctcctcttcgacatcctcgtctcctcctccctctccctctctcctacttcgcctggcctctctactgggcctgccaagggtgcgtcctaaccggcgtctgggtcatagcccacgagtgcggccaccacgccttcagcgactac

SEQ ID NO: 45691 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgtagagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45692 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatccctcgctccttctcctacctcacctgggacatcatcatagcctcctgcttctactacgtcgccaccacttacttccctcacctccctcaccctctcccttacctcgcctggcccctctactgggcctgccaaggctgcgtcctaacgggcctctgggtcatagcccacgagtgcggccaccacgccttcagcgactac

SEQ ID NO: 45693 - DNA, 343 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccatggcggacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 45694 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctctgagacctcaagaaagcaatcccacctcactacttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45695 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45696 - DNA, 317 bp, Artificial
  Mutation in BnaC.FAD2.b introduced by TALE nuclease pair BnFAD2_T03
caggatccatgggtgcaggtggaagaatgcaagtctctcctcactccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45697 - DNA, 382 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaacacccttcactctcgagtgccatctcgaaccgacgttgctggccgagacctcaagaaagcaatcccacctcactgcttcaaacgctccatccctcgctccttctcctacctcctcttcgacctcctcgtctcctcctccctctaccacctctccacagcctactgccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45698 - DNA, 414 bp, Artificial
  Mutation in BnaC.FAD2.b introduced by TALE nuclease pair BnFAD2_T03
caggatccctgggtgcaggtggaagaatgcaagtctctcctccctccagctcccccggaaccaacaccctcaaacgcgtcccctgcgagacaccaccattcactctcaggcgctggagacggtccagcggctgttgccggtgctgtgcccggcccacggcttgaccccggagccctccagaaagcaatcccacctcactgcttcaaacgctccatccctcgctccttctcctacctcctcttcgacatcctcggcgcctcctccctctaccacctctccacagcctacttccctcgcctcccccacccgcgcccttaccgcgcctggcccctctactgggcctgccaaggctgcggcctaacgggcctctgggtcatcgcccacgaatgcggccaccacgcctgcagcgactac

SEQ ID NO: 45699 - DNA, 349 bp, Artificial
  Mutation in BnaC.FAD2.b introduced by TALE nuclease pair BnFAD2_T03
caggatccatgggtgcaggtggaagaatgcaagtctctactccctccagcttccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45700 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccgccacgccttcagcgactac

SEQ ID NO: 45701 - DNA, 348 bp, Artificial
  Mutation in BnaC.FAD2.b introduced by TALE nuclease pair BnFAD2_T03
caggatccatgggtgcaggtggaagaatgcaagtctcccctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccgccctctctcctacttcgcctggcctctctactgggcctgccaagggtgcgtcctaaccggcgtctgggtcatagcccacgagtgcggccaccacgccttcagcgactac

SEQ ID NO: 45702 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 45703 - DNA, 338 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45704 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaaccccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45705 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaccgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 45706 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctggcccctctactgggcctgccaaggctgcgtcctaacgggcctctgggtcatcgcccacgaatgcggccaccacgccttcagcgactac

SEQ ID NO: 45707 - DNA, 350 bp, Artificial
  Mutation in BnaC.FAD2.b introduced by TALE nuclease pair BnFAD2_T03
caggatccatgggtgcaggtggaagaatgcaagtgtctccttcctccaagaagtctgaaaccgacaccatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45708 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgctgccaccacgccttcagcgactac

SEQ ID NO: 45709 - DNA, 351 bp, Artificial
  Mutation in BnaC.FAD2.b introduced by TALE nuclease pair BnFAD2_T03
caggatccatgggtgcaggtggaagaatgcaagtgtcccctccatccaaaaagtctgaaaccgacaacatcaagcgcgtaccctgcgagacaccgcccttcactgtgagaactcaagaaagcaatcccaccgctctgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 45710 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctaccaaggctgcgtcctaacgggcctctgggtcatagcccacgagtgcggccaccacgccttcagcgactac

SEQ ID NO: 45711 - DNA, 329 bp, Artificial
  Mutation in BnaC.FAD2.b introduced by TALE nuclease pair BnFAD2_T03
caggatccatgggtgcaggtgcaagaatgcaagtcactcctccctccagctcccccggaaccaacaccctcaaacgcgtcccctgcgagacaccaccattcaccctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45712 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaatcccacctcactgcttcaaacgctccatcccacgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 45713 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagtaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 45714 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccggacccaacaccctcaaacgcgtcccctgcgagacaccaccattcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatatcccacgagtgcggccaccacgccttcagcgactac

SEQ ID NO: 45715 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctctccgacatcctcgcctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 45716 - DNA, 334 bp, Artificial
  Mutation in BnaC.FAD2.b introduced by TALE nuclease pair BnFAD2_T03
caggatccatgggtgcagggggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45717 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacagcgagcgatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaacgggcctctgggtcatcgcccacgaatgcggccaccacgccttcagcgactac

SEQ ID NO: 45718 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccgaggctgcgtcctaacgggcctctgggtcatagcccacgagtgcggccaccacgccttcagcgactac

SEQ ID NO: 45719 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcaacatctcctcctcggctcctccctctaccacctctccacaacctacttccctctcccttacctcgcctgacccctctactgggcctgccaaggctgcgtcctaacgggcctctgggtcatcgcccacgaatgcggccaccacgccttcagcgactac

SEQ ID NO: 45720 - DNA, 333 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaaacgcgtcccctgctagacaccacccttcactagacctcaagaaagcaatcccacctcactgcttcaaacgctccatccctcgctccttctcctacctcctcttcgacatcctcgtctcctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 45721 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaacctcaagaaagcaatcccacctcactgcttcaaacgctccatcccacgctccttctcctcttcgacatcatcatctcctcctccgctcctccctctaccacctctccacagcctacttccctctcccttacctcgcctgacccctctaccgggcctgccaaggctgcgtcctaacgggcctctgggtcatagcccacgagtgcggccaccacgccttcagcgactac

SEQ ID NO: 45722 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 45723 - DNA, 349 bp, Artificial
  Mutation in BnaC.FAD2.b introduced by TALE nuclease pair BnFAD2_T03
caggatccatgggtgcaggtggaagaatgcaagtcactcctcccaccagctcccccggaaccaacaccctcaaacgcgtcccctgcgagacaccaccattcactgagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactgggcctgccagggctgcgtcctaaccggcgtctgggtcatagcccacgagtgcggccaccacgccttcagcgactac

SEQ ID NO: 45724 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttccaacgccccatccctctctccttctcctacctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgcggccaccacgccttcagcgactac

SEQ ID NO: 45725 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 45726 - DNA, 309 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45727 - DNA, 317 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacctcaagaaagcaatcccacctcactgcttcaaacgctccatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45728 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcctcttcgacatcctcgtctcctcctccctctaccacctctccacagcctacttccctctccttccccaccctctcccttccctcgcctggcccctctactgggcctgccaaggctgcgtcctaacgggcctctgggtcatcgcccacgaatgcggccaccacgccttcagcgactac

SEQ ID NO: 45729 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccatctactgggcctgccaaggctgcgtcctaacgggcgtctgggtcatagcccacgagtgcggccaccacgccttcagcgactac

SEQ ID NO: 45730 - DNA, 353 bp, Artificial
  Mutation in BnaC.FAD2.b introduced by TALE nuclease pair BnFAD2_T03
caggatccatgggtgcaggtggaagaatgcaagtctctcctccctccagctccaccggaaccaacaccctcaaacgcgtcccctgcgagacaccaccattcactccggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcagcgcccacgaatgcggccaccacgccttcagcgactac

SEQ ID NO: 45731 - DNA, 406 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaaagactgggcctttcgttttatctgttgtttgtcggtgaacgctctcctgagtaggacaaatccgccggagacctcaagaaagcaatcccacctcactgcttcaaacgctccatcccacgctccttctcctcttcgacaccatcacctccacctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45732 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccatagaactcaagaaagcaatcccaccgcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45733 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgtcatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45734 - DNA, 349 bp, Artificial
  Mutation in BnaC.FAD2.b introduced by TALE nuclease pair BnFAD2_T03
caggatccatgggtgcaggtggaagaatgcaagtctctccttcctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccacccccgcccttacctcgcctggcccctctactgggccggccaaggctgcgtcctaacgggcctctgggtcatcgcccacgaatgcggccaccacgccatcagcgactac

SEQ ID NO: 45735 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgtatgcggccaccacgccttcagcgactac

SEQ ID NO: 45736 - DNA, 336 bp, Artificial
  Mutation in BnaC.FAD2.b introduced by TALE nuclease pair BnFAD2_T03
caggatccatgggtgcaggtggaagaatgcaagtgtctcatccatccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcatacttccctctcccttacctcgcctgacccctctactgggcctgccaaggctgcgtcctaacgggcctctgggtcatagcccacgagtgcggccaccacgccttcagcgactac

SEQ ID NO: 45737 - DNA, 404 bp, Artificial
  Mutation in BnaC.FAD2.b introduced by TALE nuclease pair BnFAD2_T03
caggatccatgggtgcagggggaagaatgcaagtgtatcctccctccaagaagtctgaaaccgacaccatcaagcgcgtaccctgcgagacaccgcccttcactgtgtacgtgccccacgagtacatcgagctgatcgagatcgcccggaacagcacccaggaccggagaactcaagaaagcaatcccacctcactgcttcaaacgctccatcccacgctccttctcctcttcgacatcctcgtctcctcctccctctaccacctctccacatcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45738 - DNA, 444 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccccgcgagacaccaccattcactctctccgatttagtgctttacggggaaagccggcgaacgtggcgagaaaggaagggaagaaagcgaaaggagcgggcgctagggcgctggcaagtgtagcggttacgcgcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcctgcagcgactac

SEQ ID NO: 45739 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgattataagttacttactagacctcaagaaagcaatcccacctcactgcttcaaacgctccatcccacgctccttctcctcttcgacatcatcatctcctcctcggctcctccctctaccacctctccacagcctacttccctctcccttccctcgcctcacccctctactgggcctgccaaggctgcgtcctaacgggcctctgggtcatagcccacgagtgcggccaccacgccttcagcgactac

SEQ ID NO: 45740 - DNA, 340 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45741 - DNA, 335 bp, Artificial
  Mutation in BnaC.FAD2.b introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45742 - DNA, 404 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtctccagcgcctgcttgccgccatcgtggctggcgatggccaccacctgctccggactcaagaaagcaatcccacctcactgcttcaaacgctccatccctcgctccttctcctacctcctcttcgacatcctcgtctcctcctccctctaccacccctccacagcctacttccctctcctcccccaccctctcccttacctcgcctggcccctctactgggcctgccaaggctgcgtcctaacgggcctatgggtcatagcccacgagtgcggccaccacgccttcagcgactac

SEQ ID NO: 45743 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45744 - DNA, 336 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctacctctaccacctctccacagcctacttccatctcccttacctcgcctgacccctctactgggcctgccaagggtgcgtcctaaccggcgtctgggtcatagcccacgagtgcggccaccacgccttcagcgactac

SEQ ID NO: 45745 - DNA, 320 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 45746 - DNA, 349 bp, Artificial
  Mutation in BnaC.FAD2.b introduced by TALE nuclease pair BnFAD2_T03
caggatccatgggtgcaggtccaagaatgcaagtgtcccctccacccaagaagtctgaacccgacaccaacaagcgcgtcccctgcgagccaccacccttcactcagacctcaagaaagcaatcccacctcactgcttcaaacgctccatccctccctccttctcctacctcctcttcgacatcctcgtctcctcctccctctaccacctccccacagcctacttccctctcctcccccaccctctcccttacctcccctggcccctctactgggcctgccaaggctgcgtccgaacgggcctctgggtcatcgcccacaaatgcggccaccacgccatcagcgactac

SEQ ID NO: 45747 - DNA, 335 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtcggggtcatagcccacgagtgcggccaccacgccttcagcgactac

SEQ ID NO: 45748 - DNA, 351 bp, Artificial
  Mutation in BnaC.FAD2.b introduced by TALE nuclease pair BnFAD2_T03
caggatccatgggtgcaggtggaagaatgcaagtctcacctccctccagctcccccggaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45749 - DNA, 366 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactatcaggggataacgcaggaaagaacatgtgagcaaaaggccagcaaatctaccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 45750 - DNA, 336 bp, Artificial
  Mutation in BnaC.FAD2.b introduced by TALE nuclease pair BnFAD2_T03
caggatccatgggtgcaggtggaagaatgcaagtctatcatccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaaggctgcgtcctaacaggcctctgggtcatagcccgccagtgcggcctccgcgccttcagcgactac

SEQ ID NO: 45751 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattagacctcaagaaagcaatcccacctcactgcttcaaacgctccatcccacgctccttctcctcttcgacatcatcatctcctcctcggctcctccctctaccacctctccacagcctacttccctctcccttacctcgccggacccctctactgggcctgccaaggctgcgtcctaacgggcctctgggtcatagcccacgagtgcggccaccacgccttcagcgactac

SEQ ID NO: 45752 - DNA, 300 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaacgcgtcccctgttatcgagacctcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 45753 - DNA, 315 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 45754 - DNA, 429 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcactgccaggcgtcaaactaagcagaaggccatccgtctccagcgcctgttgccggtgctgtgccaggcccacggcttgaccccggagcaggtggagacctcaagaaagcaatcccacctcactgcttcaaacgctccatcccacgctccttctccccttcgacatcatcatctcctcctcggctcctccctctcccacctctacacagcctacttccctctcccttacctcgcctgacccctctactgggcctgccaaggctgcgtcctaacgggcctctgggtcatagcccacgagtgcggccaccacgccttcagcgactac

SEQ ID NO: 45755 - DNA, 279 bp, Artificial
  Mutation in BnaC.FAD2.b introduced by TALE nuclease pair BnFAD2_T03
caggatccatgggtgcggtggaagaatgcaagtctcgacctcaagaaagcaatcccacctcactgcttcaaacgctccatccctcgctacttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45756 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaaggctgcgtcctaacgggcctctgggtcatagcccacgagtgcggccaccacgccttcagcgactac

SEQ ID NO: 45757 - DNA, 385 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggtggataaccgtattaccgcctttgagtgagctgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccgaggctgcgtcctaacgggcctctgggtcatcgcccacgaatgcggccaccacgccttcagcgactac

SEQ ID NO: 45758 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctggcgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 45759 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 45760 - DNA, 347 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccatctcccttacctcgcctggcccctctactgggcctgccaaggctgcgtcctaacgggcctctgggtcatcgcccacgaatgcggccaccacgccttcagcgactac

SEQ ID NO: 45761 - DNA, 392 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatctggaacatcgtatgggtaatcgatgaccttacgtttaaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45762 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaacgtctgaaaccgacaacatcaagcgcgtaccctgggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45763 - DNA, 402 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccagcgcctgcttgccgccatcgtggctggcgatggccaccacctgctccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45764 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgccccagccctcgccccttctcctacctcctctacgacaccatcatctcctcctcggctcctccctctaccacctctccacagcctacttccctctcccttacctcgcctgacccctctactgggcctgccaaggctgcgtcctaacgggcctctgggtcatctccctctaatgcggccaccacgccttctgcgactac

SEQ ID NO: 45765 - DNA, 305 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45766 - DNA, 374 bp, Artificial
  Mutation in BnaC.FAD2.b introduced by TALE nuclease pair BnFAD2_T03
caggatccatgggtgcaggtggaagaatgcaagtgtctccttcccccaagaagtctgaaaccgacaccatcaagcgcgtaccctgcgagacaccgcccttcactaactccagaaacccgcggctgagtggagaactcaagaaagcaatcccacctcactgcttcaaacgctccatccctcgctccttctcctacctcctcttcgacatcctcgtctcctcctccctctaccacctctccacagcctacttccctcgcctcccccaccctctcccttacctcgcctggcccctctactgggcctgccaaggctgcgtcctaacgggcctctgggtcatagcccacgagtgcggccaccacgccttcagcgactac

SEQ ID NO: 45767 - DNA, 418 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgaggcaccaccattcactctgcgagacaccaccatgcaagtctctcctccctccagctcccccggaacccacaccctcaaacgcgtcccctgcgagacaccaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45768 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctagcgggcctctgggtcatagcccacgagtgcggccaccacgccttcagcgactac

SEQ ID NO: 45769 - DNA, 333 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45770 - DNA, 282 bp, Artificial
  Mutation in BnaC.FAD2.b introduced by TALE nuclease pair BnFAD2_T03
caggatccatgggtgcaggtggaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcttcctaacgggcctcttggtcatcgcccacgaatgcggccaccacgccttcagcgactac

SEQ ID NO: 45771 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtccactgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45772 - DNA, 351 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaacaccctcaaacgcgtcccctgcgagccaccaccattcactctagacctcaagaaagcaatcccacctcactgcttcaaacgctccatcccacgccccttctcctcttcgccatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45773 - DNA, 333 bp, Artificial
  Mutation in BnaC.FAD2.b introduced by TALE nuclease pair BnFAD2_T03
caggatccatgggtgcaggtggaagaatgcaagtgtctcctccatccaagaagtctgaaaccgacaccatcaagcgcgtaccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45774 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcacacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45775 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45776 - DNA, 335 bp, Artificial
  Mutation in BnaC.FAD2.b introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45777 - DNA, 329 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcggaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45778 - DNA, 351 bp, Artificial
  Mutation in BnaC.FAD2.b introduced by TALE nuclease pair BnFAD2_T03
caggatccatgggtgcaggtggaagaatgcaagtgtctccttcatccagctcccccggaaccaacaccatcaaacgcgtcccctgcgagacaccaccattcactctaagacctcaagaaagcaatcccacctcactgcttcaaacgctccatccctcgctccttctcctacctcctcttcgacatcctcttctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45779 - DNA, 403 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagtcctgtcgggtttcgccacctctgacttgagcgtcgatttttgtgatgctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45780 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45781 - DNA, 377 bp, Artificial
  Mutation in BnaC.FAD2.b introduced by TALE nuclease pair BnFAD2_T03
caggatccatgggtgcaggtagaagaatgcaagtctatcatccatccagctcccccgaaaccaaaaccctcaaacgcgtcccctgcgagacaccacccttccccggagcaggtggtggccatcgccagcaatattggtggagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45782 - DNA, 471 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatcatataatttctgtttaattacgttaagcatgtaataattgatggccagcaatattggtggcaagcaggcgctggagacggtgcaggcgctgttgccggtgctgtgccaggcccacggcttgacctcaagaaagcaatcccacctcactgcttcaaacgctccatccctcgctccttctcctccctccccttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45783 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 45784 - DNA, 334 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaacgggcctctgggtcatagcccacgagtgcggccaccacgccttcagcgactac

SEQ ID NO: 45785 - DNA, 334 bp, Artificial
  Mutation in BnaC.FAD2.b introduced by TALE nuclease pair BnFAD2_T03
caggatccatgggtgcaggtggaagaatgcaagtgtctccttcctccaagaagtctgaaaccgacaccatcaagcgcgtaccctgcgagacaccgcccttcactgtgaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45786 - DNA, 349 bp, Artificial
  Mutation in BnaC.FAD2.b introduced by TALE nuclease pair BnFAD2_T03
caggatccatgggtgcaggaggaagaatgcaagtctctcctccctccagctcccccgaaaccaaaaccctcaaacgcgtcccctgcgagacaccacccttcactcagacctcaagaaagcaatcccacctcactgcttcaaacgccccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45787 - DNA, 316 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaactcctccatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45788 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcttcgtcctaacgggcctctgggtcatagcccacgagtgcggccaccacgccttcagcgactac

SEQ ID NO: 45789 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaacctcaaacgcgtcccctgcgagacaccacccttcactcgagacctcaagaaaacaaccccacctcactgcttcaaacgctccacccctcgctccttctcctacctcctcttcgacatcctcgtcgcctcctccctctaccacctctccacagcctacttccctctcctccccccccctctcccttacctcgcctggcccctctactgggcctgccaaggctgcgtcctaacgggcctctgggtcatagcccacgaatgcggccaccacgccttcagcgactac

SEQ ID NO: 45790 - DNA, 431 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggcaggtggtggccatcgccagcaatggcggtggcaagcaggcgctggagacggtccagcggctgttgccggtgctgtgccaggcccacggctagacctcaagaaagcaatcccacctcactgcttcaaacgctccatcccacgctccttctcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45791 - DNA, 432 bp, Artificial
  Mutation in BnaC.FAD2.b introduced by TALE nuclease pair BnFAD2_T03
caggatccatgggtgcaggtggaagaatgcaagtctctcctccctccagctcccccggacccaacaccctcaaacgcgtcccctgcgagacaccaccattcactctcggcctggagacggtccagcggctgttgccggtgctgtgccaggcccacggcttgaccccggagcaggtggtggccatcgccagccacgatggcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctggggcatagcccacgagtgcggccaccacgccttcagcgactac

SEQ ID NO: 45792 - DNA, 317 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctcaaacgcgtcccctgccagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45793 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacaagacctcaagacaacaatcccacctcactgcttcaaacgctccatcccaccccccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45794 - DNA, 317 bp, Artificial
  Mutation in BnaC.FAD2.b introduced by TALE nuclease pair BnFAD2_T03
caggatccatgggtgcaggtggaagaatgcaagtctctcatccctccaaaaagtctgaaaccgacaacatcaaacgcgtcccctgcgagacaccacccttcactatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45795 - DNA, 350 bp, Artificial
  Mutation in BnaC.FAD2.b introduced by TALE nuclease pair BnFAD2_T03
caggatccatgggtgcaggtggaagaatgcaagtctctccttcttccagctcccccgaaaccaaaaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcagcgcccacgaatgcggccaccacgccgtcagcgactac

SEQ ID NO: 45796 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttaacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45797 - DNA, 335 bp, Artificial
  Mutation in BnaC.FAD2.b introduced by TALE nuclease pair BnFAD2_T03
caggatccatgggtgcaggtagaagaatgcaagtctctcctccctccagctcccccggaaccaacaccctcaaccgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45798 - DNA, 335 bp, Artificial
  Mutation in BnaC.FAD2.b introduced by TALE nuclease pair BnFAD2_T03
caggatccatggttgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45799 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaacgggcctctgggtcatagcccacgagtgcggccaccacgccttcagcgactac

SEQ ID NO: 45800 - DNA, 351 bp, Artificial
  Mutation in BnaC.FAD2.b introduced by TALE nuclease pair BnFAD2_T03
cagtatccatgggtgcaggtggaagaatgcaagtctctcttccctccagctcccccgaaaccaaaaccttcaaacgcgtcccctgcgagacaccacccttcactctagaacctcaagaaagcaaacccacctcactgcttcaaacgctccaaccctcgctccttctcctacctcctcttcgacatcctcgtctcctcctccctctaccacctctccacagcctacttccctcacctcccccaccctctccctttccacgccgagcccctctactgggcctgccaaggctgcgtcctaacgtgcctctgggtcatcgcccacgaatgcggccaccacgccttcagcgactac

SEQ ID NO: 45801 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 45802 - DNA, 325 bp, Artificial
  Mutation in BnaC.FAD2.b introduced by TALE nuclease pair BnFAD2_T03
caggatccatgggtgcaggtggaagaatgcaagtgtctcctccctccaaaaagtctgaagccgacaccatcaagcgcgtatagaactcaagaaagcaatcccacctcactgcttcaaacgctccatcactcgctccttctcctacctcctcttcgacatcctcgtctcctcctccctctaccacctctccacagcctacttccctctcctcccccaccctctcccttacctcgcctggcccctctactgggcctgccaaggctgcgtcataacgggcctctgggtcatcgcccacgagtgcggccaccacgccttcagcgactac

SEQ ID NO: 45803 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 45804 - DNA, 342 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtccgaacgggcctctgggtcatagcccacgagtgcggccaccacgccttcagcgactac

SEQ ID NO: 45805 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttgagacctcaagaaagcaatcccacctcactgcttcaaacgctccatccctcgctccttctcctacctcctcttctacatcctcgtctcctcctccctctaccacctctccacagcctacttccctctcctcccccaccctctctcctacttcgcctggcccctctactgggcctgccaaggctgcgtcctaacgggcctctgggtcatcgcccacgaatgcggccaccacgccttcagcgactac

SEQ ID NO: 45806 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatcccacgctccttctcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45807 - DNA, 326 bp, Artificial
  Mutation in BnaC.FAD2.b introduced by TALE nuclease pair BnFAD2_T03
caggatccatgggtgcaggtggaagaatgcaagtctctcctccctccaagaagtctgaaaccgacaccatcaagcgcgttcggctgcggcgagcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45808 - DNA, 379 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactctggtggtggccatcgccagcaatattggtggcaagcaggcgctgagacctcaagaaagcaatcccacctcactgcttcaaacgctccatcccacgctccttctcctcttcgacatcatcatctcctcctcggctcctccctctaccacctctccacagcctacttccctctcccttccctcccctgacccctctactgggcctgccaaggctgcgtcctaacgggcctctgggtcatagcccacgagtgcggccaccacgccttcagcgactac

SEQ ID NO: 45809 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaacaccctcaaacgcgtcccctgcgagacacacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45810 - DNA, 295 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 45811 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45812 - DNA, 280 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 45813 - DNA, 306 bp, Artificial
  Mutation in BnaC.FAD2.b introduced by TALE nuclease pair BnFAD2_T03
caggatccatgggtgcaggtggaagaatgcatgtctctcctccctccagctcccccggaaccaaaaccctcaaacgcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 45814 - DNA, 329 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaaagcgtcccctgcgagacaccacccttagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45815 - DNA, 344 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactctcgggaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45816 - DNA, 368 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacggtccagcggctgttgccggtgctgtgccaggcccacggcttgaccccggagcaggtggtggccagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45817 - DNA, 322 bp, Artificial
  Mutation in BnaC.FAD2.b introduced by TALE nuclease pair BnFAD2_T03
caggatccatgggtgcaggaggaagaatgcaagtctctcctccctccagctcccccggaaccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45818 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgacctcaagaaagcaatcccacctcactgcttcaaacgctccatccctcgctccttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45819 - DNA, 328 bp, Artificial
  Mutation in BnaC.FAD2.b introduced by TALE nuclease pair BnFAD2_T03
caggatccatgggtgcagggggaagaatgcaagtctttctttcctccagctcccccggaaccaacaccatccaacgagtccccaacgagacaccaccattcactcaagcaagcaatcccacctcactgcttcaaacgctccatcccaccctccttctcctcttcgacatcatcatctcctcctcggctcctccctctaccacctctccacagcctacttccctctcccttacctcgcctgacccctctactgggccggccaaggctgcgtcctaactggcctctgggtcagcgcccacgaatgctgccaccacgccttcatcgactac

SEQ ID NO: 45820 - DNA, 348 bp, Artificial
  Mutation in BnaC.FAD2.b introduced by TALE nuclease pair BnFAD2_T03
caggatccatgggtgcaggaggaagaatgcaagtctctcctccatccagctcccccggaaccaacaccctcaaacgcgtcccctgcgagacaccaccattcactctcctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45821 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45822 - DNA, 299 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccattcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45823 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactcgagacctcaagaaagcaataacacctccctgcttcaaacgctccatccctcgctccttctcctacctcctcttcgacatcctcgtctcctcctccctctaccacctctccacagcctacttcccccccctcccccccccccctcccccccccttcccccgccctctctactgcgcctgccaaggctgcgtcctaacgggcctctgggtcatagcccacgagcgcggccaccacgccttcagcgactac

SEQ ID NO: 45824 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcccctcaagaaagcaatcccacctctctgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45825 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccacctcactgcttcaaacgctccatccctcgctccttctcctacctcctcttcgacatcctcgtctcctcctccctctaccacctctccagagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45826 - DNA, 335 bp, Artificial
  Mutation in BnaC.FAD2.b introduced by TALE nuclease pair BnFAD2_T03
caggatccatgggtgcaggcggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45827 - DNA, 336 bp, Artificial
  Mutation in BnaC.FAD2.b introduced by TALE nuclease pair BnFAD2_T03
caggatccatgggtgcagggggaagaatgcaagtctttcctccctccagctcccccggaaccaacaccctcaaacgcgtcccctgcgagacaccaccattcactctagacctcaagaaagcaatcccacctcactgcttcaaacgctccatcccacgctccttctcctcttcaacatcatcatctcctcctcggctcctccctctaccacctctccacagcctacttccctctcccttacctcgcctgacccctctactgggcctgccaaggctgcgtcctaacgggcctctgggtcagagcccacgagtgcggccaccacgccatcagcgactac

SEQ ID NO: 45828 - DNA, 282 bp, Artificial
  Mutation in BnaC.FAD2.b introduced by TALE nuclease pair BnFAD2_T03
caggatccatgggtgcaggtcgaagaatgcaagtctctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 45829 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 45830 - DNA, 292 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45831 - DNA, 292 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagtccacgagtgcggccaccacgccttcagcgactac

SEQ ID NO: 45832 - DNA, 351 bp, Artificial
  Mutation in BnaC.FAD2.b introduced by TALE nuclease pair BnFAD2_T03
caggatccatgggtgcaggtggaagaatgcaagtgtcccctccatccaagaagtctgaacccgacaccatcaagcgcgtaccctgcgagacaccgcccttcactgtagaactcaagaaagcaatcccacctcactgcttcaaacgctccatcccaccctccttctcctcttccacatcatcatctcctcctcgcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45833 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctcctgggcctgccaaggctgcgtcctaacgggcctctgggtcataggccacgagtgcggccaccacgccttcagcgactac

SEQ ID NO: 45834 - DNA, 394 bp, Artificial
  Mutation in BnaC.FAD2.b introduced by TALE nuclease pair BnFAD2_T03
caggatccatgggtgcaggtggaagaatgcaagtctctcctccctccagctcccccggaaccaaaaccctccaacgcgtcccctgtgagacaccacccttcactctcgttcaaatccgctcccggcggatttgtcctactcaggtgaacgagacctcaagaaagcaatcccacctcactgcttcaaacgctccgtccctcgctccttccccaacctcctcttcgacatcctcgtctcctcctccctctaccacctctccacagcctacttccccctcctcccccaccctctcccttacctcgcctggcccctctactgggcctgccaaggctgcgtcctaacgggcctctgggtcatcgcccacgaatgcggccaccacgccttcagcgactac

SEQ ID NO: 45835 - DNA, 346 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaacccacaaacgcgtccccagcgagacaccacccttcactacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcggcctaacgggcctctgggtcatagcccgcgagtgctgccaccgcgccatcaacgactac

SEQ ID NO: 45836 - DNA, 341 bp, Artificial
  Mutation in BnaC.FAD2.b introduced by TALE nuclease pair BnFAD2_T03
caggatccatgggtgcaggggaaagaatgcaagtctcaccctcctccagctcccccggaaccaacaccctcaaccgcgtcccctgcgagccaccaccattcactctacctcaagaaagcaatcccacctcactgcttcaaacgctccatcccacgctccttctcctcttcgacatcatcatctcctcctccctctaccacctctccacagcctacttccctctcctcccccaccctcgcccttacctcgcctggtccctctactgggcctgccaaggctgcgtcctaacgggcctcggggtcatcgcccacgaatgcggccaccacgccttcaacgactac

SEQ ID NO: 45837 - DNA, 346 bp, Artificial
  Mutation in BnaC.FAD2.b introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcacgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45838 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45839 - DNA, 336 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45840 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttccaggcccacggcttgaccccccagcaggtggtggccatcgccagcaatggacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45841 - DNA, 328 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatcccacgctccttctcctcttcgacatcatcatctcctcctcggctcctccctctaccacctctccacagcctacttccctctcccttccctcgcctgacccctctactgggcctgccaaggctgcgtcctaacgggcctctgggtcatagcccacgagtgcggccaccacgccttcagcgactac

SEQ ID NO: 45842 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctcctccccctacctcctcttcgacatcctcgtctcctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45843 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgcctggcccctctactgggcctgccaaggctgcgtcctaacgggcctctgggtcatcgcccacgaatgcggccaccacgccttcagcgactac

SEQ ID NO: 45844 - DNA, 279 bp, Artificial
  Mutation in BnaC.FAD2.b introduced by TALE nuclease pair BnFAD2_T03
caggatccatgggtgcaggtggaagaatgcaagtctcccctaccaccagctcccccgaaaccaaaaccctcaaccgagtcccctacgagacaccacccttcactcttcgacatcctcgtctcctcctccctctaccacctctccacagcctacttccctctcctcccccaccctctcccttacctcgccaggcccctctactgggcctgccaaggctgcgtcctaacgggcctctgggtcatcgccctcgtatgcggccaccacgccttgagcgactac

SEQ ID NO: 45845 - DNA, 343 bp, Artificial
  Mutation in BnaC.FAD2.b introduced by TALE nuclease pair BnFAD2_T03
caggatccatgggtgcaggtggaagaatgcaagtgtcccctccctccaaaaagtctgaaaccgacaacatcaagcgcgtaccctgcgagacaccgcccttcactgtagaactcaagaaagcaatcccacctcactgcttcaaacgctccatcccaccctccttctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45846 - DNA, 349 bp, Artificial
  Mutation in BnaC.FAD2.b introduced by TALE nuclease pair BnFAD2_T03
caggatccatgtgtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctactccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45847 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggcggcgtcctaacgggcctctgggtcatagcccacgagtgcggccaccacgccttcagcgactac

SEQ ID NO: 45848 - DNA, 315 bp, Artificial
  Mutation in BnaC.FAD2.b introduced by TALE nuclease pair BnFAD2_T03
caggatccatgggtgcaggtgaaagaatgcaagtctctcatccctcccgtccccccggaaacaacaccctcagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45849 - DNA, 350 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctaccccctcttcgacatcctcgtctcctcctccctctaccacccctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45850 - DNA, 349 bp, Artificial
  Mutation in BnaC.FAD2.b introduced by TALE nuclease pair BnFAD2_T03
caggatccatgggtgcagggggaagaatgcaagtctctcccccctacagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgccctcgaatgcggccaccacgccttcatcgactac

SEQ ID NO: 45851 - DNA, 334 bp, Artificial
  Mutation in BnaC.FAD2.b introduced by TALE nuclease pair BnFAD2_T03
caggatccatgggtgcaggtggaagaatgcaagtctctcctccctccagccccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45852 - DNA, 338 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45853 - DNA, 331 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactctcggcttcactgcttcaaacgctccatcccgcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45854 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaggacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 45855 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 45856 - DNA, 402 bp, Artificial
  Mutation in BnaC.FAD2.b introduced by TALE nuclease pair BnFAD2_T03
caggatccatgggtgcaggtgcaagaatgcaagtctcccccccctccagctcccccgaaaccaaaaccctcaaacgcgtcccctgcgagacaccacccttcactctcggctgttgccggtgctgtgccaggcccacggcttgaccccccagcaggtgcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45857 - DNA, 278 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaaccttcactctcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45858 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagcgtgcgtcctaaccggcgtctgggtcatagcccacgagtgcggccaccacgccttcagcgactac

SEQ ID NO: 45859 - DNA, 335 bp, Artificial
  Mutation in BnaC.FAD2.b introduced by TALE nuclease pair BnFAD2_T03
caggatccatgggtgcaggtggaagaatgcaagtctcccctccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggggcatatcccacgagtgcggccaccgcgccatcagcgactac

SEQ ID NO: 45860 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctagcaggcgctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 45861 - DNA, 336 bp, Artificial
  Mutation in BnaC.FAD2.b introduced by TALE nuclease pair BnFAD2_T03
caggatccatgggtgcaggtgcaagaatgcaagtctctcctccatccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccatctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45862 - DNA, 337 bp, Artificial
  Mutation in BnaC.FAD2.b introduced by TALE nuclease pair BnFAD2_T03
caggatccatgggtgtaggtggaagaatgcaagtctctcctccctccagctcccccggaaccaacaccctcaaacgcgtcccctgcgagacaccaccattcactctcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45863 - DNA, 279 bp, Artificial
  Mutation in BnaC.FAD2.b introduced by TALE nuclease pair BnFAD2_T03
caggatccatgggtgcaggtggaagaatgcaagtctctccaccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctctactgggcctgccaaggctgcgtcctaacgggcctctgggtcatctcccacgagtgcggccaccacgccttcagcgactac

SEQ ID NO: 45864 - DNA, 427 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacagcaccggcaacagccgctggaccgtctccagcgcctgcttgccaccgccaagccgtgggcctggcacagcaccggcaacagccgctggacgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 45865 - DNA, 331 bp, Artificial
  Mutation in BnaC.FAD2.b introduced by TALE nuclease pair BnFAD2_T03
caggatccatgggtgcaggtgcaagaatgcaagtctcccctgcatccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccgacgtctggggcatagcccacgagtgcggccaccgcgccttcaacgactac

SEQ ID NO: 45866 - DNA, 351 bp, Artificial
  Mutation in BnaC.FAD2.b introduced by TALE nuclease pair BnFAD2_T03
caggatccatgggtgcaggtgaaagaatgcaagtctcaccccccaccagctcccccgaaaccaaaaccatcaaccgcgtcccctgcgagacaccacccttcactcggagacctcaagaaagcaatcccacctcactgcttcaaacgctccatccctcgctccttctcctacctcctcttcgacatcctcgtctcctcctccctctaccaccgctccacagcctacttccctctcctcccccacccgctcccttacctcacctggcccctctactgggcctgccaaggctgcgtcctaacgggcctcgggggcatcgctcgcaagtgctgcctccacgccatgagcgactac

SEQ ID NO: 45867 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctctccgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45868 - DNA, 336 bp, Artificial
  Mutation in BnaC.FAD2.b introduced by TALE nuclease pair BnFAD2_T03
caggatccatgggtgcaggtagaagaatgcaagtctctcatccctccagctcccccggaaccaacaccctcaaacgcgtcccctgcgagacaccaccattcactaaagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggccggccaaggctgcgtcctaacgggcctctggttcagagcccacgagtgcggccaccacgccttcagcgactac

SEQ ID NO: 45869 - DNA, 380 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcgacaaataatgattttatttcgactgattgtgtcctgttggagaactcaagaaagcaatcccacctcactgcttcaaacgctccatcccaccctccttctcctcttcgacatcatcatctcctcctcggctcctccctctaccacctccccacagcccacttccctctcccttacctcgcctggcccctctactgggcctgccaaggctgcgtcctaacgggcctctgggtcatagcccacgagtgcggccaccacgccttcagcgactac

SEQ ID NO: 45870 - DNA, 314 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagctcaagaaagcaatcccaccgcactgtttcaaacgctccatccctcgctcattctcctccctcctcttcgacatcctcatcgcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 45871 - DNA, 345 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45872 - DNA, 422 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcgctggagacggtccagcggctgttgccggtgctgtgccaggcccacggcttgaccccccagcaggtggtggccatagacctcaagaaagcaatcccccctcactgcttcaaacgctccatccctcgctccttctcctacctcctcttcgacacccccgtctcctcctcggctcctccctctcccgcctccccacagcctacttccctctcccttacctcgcctgacccctctacggggcctgccaaggctgcgtcctaacgggcctctgggtcatagcccacgagtgcggccaccacgccttcagcgactac

SEQ ID NO: 45873 - DNA, 335 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcagagcccacgagtgcggccaccacgccttcagcgactac

SEQ ID NO: 45874 - DNA, 332 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacatcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45875 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaccgcgtcccctgcgagacaccacccttcactctctcaaaaaagcaatcccacctcactgcttcaaactctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45876 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45877 - DNA, 414 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggccgccattgctggcgatggccaccacctgctgaggggtcaacccgcgggcctggcacagcaccggcaccagccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45878 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccatcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctccccccccaccctctcccttacctcgcctggcccctctactgggcctgccaaggctgtgtcctaacgggcctctgggtcatcgcccacgaatgcggccaccacgccttcagcgactac

SEQ ID NO: 45879 - DNA, 335 bp, Artificial
  Mutation in BnaC.FAD2.b introduced by TALE nuclease pair BnFAD2_T03
caggatccatgggtgcaggtggaagaatgcaagtatctcctccctccagctcccccggaaccaacaccctcaaacgcgtcccctgcgagacaccacccttcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgaccactctactgggcctgccaaggctgcgtcctaacgggcctctgggtcatagcccacgagtgcggccaccacgccttcagcgactac

SEQ ID NO: 45880 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagcctacttccctctcctcccccaccctctcccttacctcgcctggcccctatactgggcctgccaaggctgcgtcctaacgggcctctgggtcatcgcccacgaatgcggccaccacgccttcagcgactac

SEQ ID NO: 45881 - DNA, 335 bp, Artificial
  Mutation in BnaC.FAD2.b introduced by TALE nuclease pair BnFAD2_T03
caggatccatgggtgcaggtggaagaatgcaagtctatcatccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45882 - DNA, 338 bp, Artificial
  Mutation in BnaC.FAD2.b introduced by TALE nuclease pair BnFAD2_T03
caggatccatgggtgcaggtggaagaatgcaagtctatcccacctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcgtctcctcctccctctaccacctctccacagcctacttccctctcccttacctcgcctgacccctctactgggcctgccaaggctgcgtccgaacgggcctctgggttatagctcacgagtgcggcgaccgcgccatcagcgactac

SEQ ID NO: 45883 - DNA, 317 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45884 - DNA, 317 bp, Artificial
  Mutation in BnaC.FAD2.b introduced by TALE nuclease pair BnFAD2_T03
caggatccatgggtgcaggtggaagaatgcaagtctctcccacctccagctcccccgaaaccaacaccctcaaacgcgtcccctgcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45885 - DNA, 350 bp, Artificial
  Mutation in BnaC.FAD2.b introduced by TALE nuclease pair BnFAD2_T03
caggatccatgggtgcaggtggaagaatgcaagtctctactccctccagctcccccggaaccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45886 - DNA, 334 bp, Artificial
  Mutation in BnaC.FAD2.b introduced by TALE nuclease pair BnFAD2_T03
caggatccatgggtgcaggagcaagaatgcaagtctcacctccctccagctcccccgaaaccaaaaccctcaaacgcgtcccctgcgagacaccacccttcactcgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45887 - DNA, 349 bp, Artificial
  Mutation in BnaC.FAD2.b introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45888 - DNA, 350 bp, Artificial
  Mutation in BnaC.FAD2.b introduced by TALE nuclease pair BnFAD2_T03
caggatccatgggtgcagggggaagaatgcaagtctctcctccctccagctcccccgaaaccaaaaccctcaaacgcgtcccctgcgagacaccaccattcactctagacctcaagaaagcaatcccaccgcactgtttcaaacgctacatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 45889 - DNA, 344 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45890 - DNA, 431 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctcggctgttgccggtgctgtgccaggcccacggcttgaccccccagcaggtggtggccatcgccagcaatggcggtggcaagcaggcgctggagacggacctcaagaaagcaatcccacctcactgcttcaaacgctccatcccacgctccttctcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45891 - DNA, 335 bp, Artificial
  Mutation in BnaC.FAD2.b introduced by TALE nuclease pair BnFAD2_T03
caggatctatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45892 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcccctctactgggcctgccaaggctgcgtcctaaccggcgtctgggtcatagcccacgagtgcggccaccacgccttcagcgactac

SEQ ID NO: 45893 - DNA, 335 bp, Artificial
  Mutation in BnaC.FAD2.b introduced by TALE nuclease pair BnFAD2_T03
caggatccatgggtgcaggtgaaagaatgcaagtctcacctccctccagctcccccggaaccaacaccctcaaacgcgtcccctacgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45894 - DNA, 416 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagcgcctgctgccggtgctgtgccaggcccacggcttgaccccccagcaggtggtggccatcgccagcaataatggtggcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45895 - DNA, 334 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcaacctcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45896 - DNA, 338 bp, Artificial
  Mutation in BnaC.FAD2.b introduced by TALE nuclease pair BnFAD2_T03
caggatccatgggtgcaggtggaagaatgcaagtgtctccttcctccaagaagtctgaaaccgacaacatcaagcgcgtaccctgcgagacaccgcccttcacaactcaagaaagcaatcccaccgcactgtttcaaacgctcgatccctcgctctttctcctacctcctcttcgacatcctcgtctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 45897 - DNA, 313 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctcttcgacatcatcatctcctcctcggctcctccctcaccctctcccttacctcgcctggcccctctactgggcctgccaaggctgcgtcctaacgggcctctgggtcatcgcccacgaatgcggccaccacgccttcagcgactac

SEQ ID NO: 45898 - DNA, 345 bp, Artificial
  Mutation in BnaC.FAD2.b introduced by TALE nuclease pair BnFAD2_T03
caggatccatgggtgcagggagaagaatgcaagtctctcctcctcccagctcccccgaaaccaaaacactcaaccacgtccccagcgcgacaccacccttaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctggttcagcgcccacgaatgcggccgccacgccttcatcgactac

SEQ ID NO: 45899 - DNA, 335 bp, Artificial
  Mutation in BnaC.FAD2.b introduced by TALE nuclease pair BnFAD2_T03
caggatccatgggtgcaggtggaagaatgcaagtgtctcctccatccaagaagtctgaaaccgacaccatccagcgcgtaccctgcgagacaccgcccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 45900 - DNA, 343 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcaagacctcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45901 - DNA, 345 bp, Artificial
  Mutation in BnaC.FAD2.b introduced by TALE nuclease pair BnFAD2_T03
caggatccatgggtgcaggcggaagaatgcaagtctctcctccatccagctcccccggaaccaacaccctcaaacgcgtcccctgcgagacaccacccttcactcctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 45902 - DNA, 331 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactaactcaagaaagcaatcccaccgcactgcttcaaacgctcgatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45903 - DNA, 279 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttcgacatcctcgtctcctcctccctctaccacctctccacagccttcttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45904 - DNA, 336 bp, Artificial
  Mutation in BnaC.FAD2.b introduced by TALE nuclease pair BnFAD2_T03
caggatccatgggtgcaggtgcaagaatgcaagtatatcgtccctacagctcccccggaaccaacaccaccaaacccgtcccctgcgagacaccaccattcactctagacctcaagaaagcaatcccacctcactgcttcaaacgctacatcccacgctccttctcctcttcgacatcagcatctccaccactactcatccctctaccacctctccacagcctacttcactctcccttaactcgcctgacccctctactgggcctgccaaggctgcgtcctaacgggcctcggggtgatcgcccactaatgcggccaccacgccttcggccactac

SEQ ID NO: 45905 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttaccccgcctgacccctctactgggcctgccaaggctgcgtcctaacgggcctctgggtcatagcccacgagtgcggccaccacgccttcagcgactac

SEQ ID NO: 45906 - DNA, 351 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatccaacctcactgcttcaaacgctccatcccacgctccttctcctacctcctcttcgacatcctcgtctcctcctccctctaccacctctccacagcctacttccctctcctcccccaccctctcccttacctcgcctggcccctctactgggcctgcaaaggctgcgtcctaacgggcctctgggtcatcgcccacgaatgcggccaccacgccttcagcgactac

SEQ ID NO: 45907 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgcttcaaacgctccatccctcgctccttctcctacctcctcttcgacatcctcgtctcctcctccctctaccacctctccacatcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45908 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccaccgcactgtttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45909 - DNA, 329 bp, Artificial
  Mutation in BnaC.FAD2.b introduced by TALE nuclease pair BnFAD2_T03
caggatccatgggtgcaggtggaagaatgcaagtgtctcctccatccaagaagtctgaaaccgacaacatcaaacgcgtcccctgcgagacaccacccttcactccacctcactgcttcaaacgctccatccctcgctccttctcctacctcctcttcgacatcctagtctcctcctccctctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 45910 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 45911 - DNA, 335 bp, Artificial
  Mutation in BnaC.FAD2.b introduced by TALE nuclease pair BnFAD2_T03
caggatccatgggtgcaggtggaagaatgcaagtctctcattcctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgcgccggccaaggctgcgtcctaacgggcctctgggtcagagcccacgagtgctgcgaccgcgccttcagcgactac

SEQ ID NO: 45912 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaccgcgtcccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45913 - DNA, 347 bp, Artificial
  Mutation in BnaC.FAD2.b introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45914 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttttggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45915 - DNA, 357 bp, Artificial
  Mutation in BnaC.FAD2.b introduced by TALE nuclease pair BnFAD2_T03
caggatccatgggtgcaggtgaaagaatgcaagtctgacactccaccagctcccccggaaccaacaccatcaaacacgtcccctgcgagacaccacccttcactctcggcctttttacggttcctctccctcccacctcactgcttcaaacgctccatccctcgctccttctcctacctcctcttcgacatcctcgtctcctcctccctctaccacctctccacagcctacttccctctcctcccccaccctctcccttacctcgccgggcccctctactgggcctgccaaggctgcgtctgaacgggcctctgggtcatcgcctgcgaatgctgcgtccacgccatcagcaactac

SEQ ID NO: 45916 - DNA, 331 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45917 - DNA, 336 bp, Artificial
  Mutation in BnaC.FAD2.b introduced by TALE nuclease pair BnFAD2_T03
caggatccatgggtgcaggcgcaagaatgcaagtctctcctccatccagctcccccgaaaccaaaaccctcaaacgcgtcccctgcgagacaccacccttcactctccatcccacctcactgcttcaaacgctccatccctcgctccttctcctacctcctcttcgacatcctcgtctcctcctccctctaccacctctccacagtctacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 45918 - DNA, 372 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcacatgttctttcctgcgttatcccctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45919 - DNA, 381 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggagagcgttcaccgacaaacaacagacaaaacgaaaggcccagtcacctcaagaaatcaatcccacctcactgcttcaaacgctccatcccacgctccttctcctcttcgacatcatcatctcctcctcggctcctccctctcccacctccccccagcctacttccctctcccttacctcgcctggcccctctactgggcctgccaaggctgcgtcctaacgggcctctgggtcatagcccacgagtgcggccaccacgccttcagcgactac

SEQ ID NO: 45920 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 45921 - DNA, 337 bp, Artificial
  Mutation in BnaC.FAD2.b introduced by TALE nuclease pair BnFAD2_T03
caggatccatgggtgcaggtggaagaatgcaagtctctcatccatccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45922 - DNA, 336 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45923 - DNA, 350 bp, Artificial
  Mutation in BnaC.FAD2.b introduced by TALE nuclease pair BnFAD2_T03
caggatccatgggtgcaggtgaaagaatgcaagtctcacccccctccagctcccccggaaccaacaccctcaaacgcgtcccctgcgagacacctccattcactcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtccgaacgggcctctgggtcatcgcccacgaatgcggccaccacgccttcagcgactac

SEQ ID NO: 45924 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgaacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 45925 - DNA, 319 bp, Artificial
  Mutation in BnaC.FAD2.b introduced by TALE nuclease pair BnFAD2_T03
caggatccatgggtgcaggtggaagaatgcaagtctcccctccctccagctcccccggaaccaacaccctcaaacgcgtcccctgcgagacaccaccattcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 45926 - DNA, 265 bp, Artificial
  Mutation in BnaC.FAD2.b introduced by TALE nuclease pair BnFAD2_T03
caggatccatgggtgcaggtggaagaatgcaagtctctcctccctccagtctctccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaacgggcctctgggtcatagcccacgagtgcggccaccacgccttcagcgactac

SEQ ID NO: 45927 - DNA, 349 bp, Artificial
  Mutation in BnaC.FAD2.b introduced by TALE nuclease pair BnFAD2_T03
caggatccatgggtgcaggtggaagaatgcaagtctctcctccctacagctcccccgaacccaaaaccctcaaacgcgtcccctgcgagccaccacccttcactcagacctcaagaaagcaatcccacctcactgcttcaaacgctccatccctcactccttctcctacctcctcttcgacatcctcgtctcctcctccctctaccacctctccacagcctacttccctctcctcccccacccgctcccttacctcgcctggcccctctactgggcctgccaaggctgcgtcctaacgggcctctggggcatcgcccacaaatgcggcctccacgccatcagcgactac

SEQ ID NO: 45928 - DNA, 294 bp, Artificial
  Mutation in BnaC.FAD2.b introduced by TALE nuclease pair BnFAD2_T03
caggatccatgggtgcaggtgcaagaatgcaagtctctcctccctccagctcccccggaaccaacaccctccagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45929 - DNA, 326 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcacaagaaagcaatcccacctcactacttcaaacgctccatcccacgccccttctcctcttcgacatcatcatctcctcctcggcgcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45930 - DNA, 349 bp, Artificial
  Mutation in BnaC.FAD2.b introduced by TALE nuclease pair BnFAD2_T03
caggatccatgggtgcaggtgaaagaatgcaagtgtgaccttccaccaaaaagtctgaaaccgacaacatcaagcgcgtaccctgcgagacaccgcccttcactgagaactcaagaaagcaatcccacctcactgcttcaaacgctcaatccctcgctccttctcctacctcctcttcgacatcctcgtctcctcctccctctaccacctctccacagcctacttccctctcctcccccaccctcgcccttacctcgcctggcccctctactgggcctgccaaggctgcgtccgaacgggcctctgggtcacagcccgcgagtgcggcgaccgcgccttgagcgactac

SEQ ID NO: 45931 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaaaaccctcaaccgcgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 45932 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 45933 - DNA, 343 bp, Artificial
  Mutation in BnaC.FAD2.b introduced by TALE nuclease pair BnFAD2_T03
caggatccatgggtgcaggtggaagaatgcaagtctaacctccctccagctcccccggaaccaacaccctcaaacgcgtcccctgcgagacaccaccattcactcagacctcaagaaagcaatcccacctcactgcttcaaacgctccatcccacgctcctacctcctcttcgacatcctcgtctcctcctccctctaccacctctccacagcctacttccctctccccccccaccctctcccttacctcgcctggcccctctactgggcctgccaaggctgcgtcctaacgggcctctgggtcatcgcccgcgaatgcggccaccacgccatcagcgactac

SEQ ID NO: 45934 - DNA, 350 bp, Artificial
  Mutation in BnaC.FAD2.b introduced by TALE nuclease pair BnFAD2_T03
caggatccatgggtgcaggtggaagaatgcaagtctcccctccctccagctcccccgaaaccaaaaacctcaaacgcgtcccctgcgagacaccacccttcactctagacctcaagaaagcaatcccccctcactgcttcaaacgctccatcccccgctccttctcctacctcctcttcgacatcctcgtcgcctcctccctctactacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 45935 - DNA, 331 bp, Artificial
  Mutation in BnaC.FAD2.b introduced by TALE nuclease pair BnFAD2_T03
caggatccatgggtgcaggtggaagaatgcaagtctatcctcccttcagctcccccggaaccaacaccctcaaacgcgtcccctgcgagacaccaccattcacacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctggggcatcgcccacaaatgcggcgaccgcgccatcagcgactac

SEQ ID NO: 45936 - DNA, 428 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggcacagcaccggcaacagccgctggaccgtcaggatggccttctgcttagtttgatgcctggcagtttatggcgggcaggaacctcaagaaagcaatcccaccgcactgctacaaacgctccatccctcgctccttctcctccctcctcttcgacatcctcgtctcctcctccctctaccacctctccacagcctacttccctctcctcccccaccctctcccttacctcgcctggcctctctactgggcctgccagggctgcgtcctaacgggcctctgggtcatagcccacgagtgcggccaccacgccttcagcgactac

SEQ ID NO: 45937 - DNA, 350 bp, Artificial
  Mutation in BnaC.FAD2.b introduced by TALE nuclease pair BnFAD2_T03
caggatccatgggtgcaggtggaagaatgcaagtctctcctccacccagctcccccggacccaacaccctcaaacgcgtcccctgcgagacaccaccatcccctcagacctcaagaaagcaatcccacctcactgcttcaaacgctccatcccacgctccttctcctcttcgacatcatcatctcctcctcggctcctccctctaccacctctccacagcctacttccctcgcctcccccaccctcgcccttacctcgcctggcccctctactgggcctgccaaggctgcgtcctaacgggcctctggttcagagcgcacgagtgctgccaccacgccttcagcgactac

SEQ ID NO: 45938 - DNA, 415 bp, Artificial
  Mutation in BnaC.FAD2.b introduced by TALE nuclease pair BnFAD2_T03
caggatccatgggtgcaggtggaagaatgcaagtctctcatccctacagctcccccgaaaccaaaaccctcaaacgcgtcccctgcgagacaccacccttcactctagagcggatttgtcctactcaggagagcgttcaccgacaaacaacagataaaacgaaaggctcagagacctcaagaaagcaatcccacctcactgcttcaaacgctccatccctcgctccttctcctacctcctcttcgacatcctcgtctcctcctccctctaccaccgctccacagcctacttccctctcctcccacaccctctcccttacctcgcctggcccctctactgggcctgccaaggctgcgtccgaacgggcctctgggtcatcgcccacgaatgcggcgaccacgccttcagcgactac

SEQ ID NO: 45939 - DNA, 315 bp, Artificial
  Mutation in BnaC.FAD2.b introduced by TALE nuclease pair BnFAD2_T03
caggatccatgggtgcaggtggaagaatgcaagtctctcctccctcacgtccccccggaaacaacaccctcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45940 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctccgagacaccaccattcacttagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45941 - DNA, 352 bp, Artificial
  Mutation in BnaC.FAD2.b introduced by TALE nuclease pair BnFAD2_T03
caggatccatgggtgcagggagaagaatgcaagtctctcctccccccagctcccccgaaaccaaaaccctcaaacgcgtcccctgcgagacaccacccttcactctagagacctcaagaaagcaatcccacctcactccttcaaacgctccatccctcgctccttctcctacctcctcttcgacatcctcgtctcctcctccctctaccacctctccacagcctacttccctctcctcccccaccctctcccttacctcgcctggcccctctactgggtctgccaaggctgcgtcctaacgggcctctgggtcagcgcccacgaatgcggccaccacgccttcatcgactac

SEQ ID NO: 45942 - DNA, 346 bp, Artificial
  Mutation in BnaC.FAD2.b introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45943 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaaggctgcgtcctaacgggcctctgggtcatagcccacgagtgcggccaccacgccttcagcgactac

SEQ ID NO: 45944 - DNA, 389 bp, Artificial
  Mutation in BnaC.FAD2.b introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgttaggtacctcgcgaatgcatctagatccaatgatcatgagcggagaattaaggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45945 - DNA, 300 bp, Artificial
  Mutation in BnaC.FAD2.b introduced by TALE nuclease pair BnFAD2_T03
caggatccatgggtgcaggtggaagaatgcaagtctctcatccctccagctcccccgaaaccaaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45946 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgccccatccctcgctccttctcctacctcctcttcgacatcctcgtctcctcctccctctaccacctctccacagcctacttccctctcctcccccaccctctcccttacctcgcctggcccctctactgggccggccaaggctgcgtcctaacgggcctctgggtcatcgcccacgaatgcggccaccacgccttcagcgactac

SEQ ID NO: 45947 - DNA, 336 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45948 - DNA, 341 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45949 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgagagaccccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccagggctgcgtcctaacgggcctctgggtcatcgcctgcgaatgcggccaccacgccttcagcgactac

SEQ ID NO: 45950 - DNA, 403 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctagatcgccgatatcgatgctgtccatgtgctgtctctcgaacttggctgcgccagtctccctatcggagacctcaagaaagcaatcccacctcactgtttcaaacgctccatcccacgctccttctcctctccgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 45951 - DNA, 345 bp, Artificial
  Mutation in BnaC.FAD2.b introduced by TALE nuclease pair BnFAD2_T03
caggatccatgggtgcaggtggaagaatgcaagtgtcccctccacccaagaagtctgaaaccgacaccatcaaacgcgtcccctgcgagacaccacccttaagacctcaagaaagcaatcccacctcactgcttcaaacgctccatccctcgctccttctcctacctcctcttcgacatcctcgtctcctcctccctctaccacctttccactgcctactcccctctcctcccccaccctctccctgacctcgcctggcccctctacagggcctgccaaggctgcgtcctaacgggcctctgggtcatcgcccgcgaatgcggccaccacgccatcagcgactac

SEQ ID NO: 45952 - DNA, 325 bp, Artificial
  Mutation in BnaC.FAD2.b introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactctaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 45953 - DNA, 352 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctaagacctcaagaaatcaatcccacctcactgcttcaaacactccatcccacgctccttctcctcttcgacatcatcatctcctcctcggcacctccctctaccacctctccacatcctacttcccgctcccccccctcccgctcccttacctcgcctggcccctctactgggcctgccaaggctgcgtcctaacgggcctctgggtcatcgcccacgagtgcggccaccacgccttcagcgactac

SEQ ID NO: 45954 - DNA, 346 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45955 - DNA, 348 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45956 - DNA, 335 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgctgccaccacgccttcagcgactac

SEQ ID NO: 45957 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgggaactcaagaaagcaatcccaccgcactgtttcaaacgccccatccctcgctccttctcctacctcctcttcgacatcctcgtctcctcctccctctaccacctctccacagcctacttccctctcctcccccaccatctcccttacctcgcctggcccctctactgggcctgccaaggctgcgtcctaacgggcctctgggtcatcgcccacgaatgcggccaccacgccttcagcgactac

SEQ ID NO: 45958 - DNA, 325 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccacctcactgcttcaaacgctccatcccacgctccttctcctcttcgacatcatcatctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45959 - DNA, 338 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45960 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaacaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45961 - DNA, 351 bp, Artificial
  Mutation in BnaC.FAD2.b introduced by TALE nuclease pair BnFAD2_T03
caggatccatgggtgcaggtggaagaatgcaagtctcccctccccccagctcccccgaaaccaaaaccctcaaacgcgtcccctgcgagacaccacccttcactcggcgacctcaagaaagcaatcccacctcactgcttcaaacgctccatccctcgctccttctcctacctcctcttcgacatcctcgtctcctcctccctctaccaccgctccacagcctacttccctctcctcccccaccctctcccttacctcgcctggcccctctactgggcctgccaaggctgcgtcctaacgggcctctggggcagcgcccacgaatgcggccaccacgccttcagcgactac

SEQ ID NO: 45962 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcactccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45963 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgtgagacaccaccattcactagacctcaagaaagcaatcccacctcactgcttcaaacgctccatcccacgctccttctcctcttcgacatcatcatctcctcctcggctcctccctctaccacctctccacagcctacttccctctcccttacctcgcctaacccctctactgggcctgccaaggctgcgtcctaacgggcctctgggtcatagcccacgagtgcggccaccacgccttcagcgactac

SEQ ID NO: 45964 - DNA, 335 bp, Artificial
  Mutation in BnaC.FAD2.b introduced by TALE nuclease pair BnFAD2_T03
caggatccatgggtgcaggtgaaagaatgcaagtctcacacccctccagctcccccggaaccaacaccctcaaacgcgtcccctgcgagacaccaccattcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtccgaacgggcctctgggtcatcgcccacgaatgcggccaccacgccttgagcgactac

SEQ ID NO: 45965 - DNA, 351 bp, Artificial
  Mutation in BnaC.FAD2.b introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45966 - DNA, 276 bp, Artificial
  Mutation in BnaC.FAD2.b introduced by TALE nuclease pair BnFAD2_T03
caggatccatgggtgcaggtggaagaatgcaagtctctcctctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccaccccttcagcgactac

SEQ ID NO: 45967 - DNA, 321 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccacctcaagaaagcaatcccacctcactgcttcaaacgctccatcccacgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45968 - DNA, 346 bp, Artificial
  Mutation in BnaC.FAD2.b introduced by TALE nuclease pair BnFAD2_T03
caggatccatgggtgcaggtggaagaatgcaagtctctcccccctccagctcccccgaaaccaaaaccctcaaacgcgtcccctgcgagacaccacccttaaagacctcaagaaagcaatcccacctcactgcttcacacgctccatccctcgctccttctcctacctcctcttcgacatcctcgtctcctcctccctctaccacctccccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45969 - DNA, 351 bp, Artificial
  Mutation in BnaC.FAD2.b introduced by TALE nuclease pair BnFAD2_T03
caggatccatgggtgcatgtggaagaatgcaagtctatcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctggttcatcgcccacgaatgcggccaccacgccttcagcgactac

SEQ ID NO: 45970 - DNA, 402 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctgttgccggtgctgtgccaggcccacggcttgaccccccagcaggtggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatctcccacgaatgcggccaccacgccttcagcgactac

SEQ ID NO: 45971 - DNA, 326 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctttagcaatcccacctcactgcttcgaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45972 - DNA, 439 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagcgcctgcttgccaccgccattgctggcgatggccaccacctgctggggggtcaagccgtgggcctggcacagcaccggcaacagccgctgacctcaagaaagcaatcccacctcactgcttcaaacgctccatccctcgctccttctcctacctccgcttcgacatcctcgtcccctcctccctctaccacctctccacagcctacttccctctcctcccccaccctctcccttacctcgcctggcccctctactgggcctgccaaggctgcgtcctaacgggcctctgggtcatcgcccacgaatgcgaccaccacaccttcagcgactac

SEQ ID NO: 45973 - DNA, 449 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaactgccaggcatcaaactaagcagaaggccatccggcaatggcggtggccaccaccttctggggggtcaagccgtgggcctggcacagcaccggcaacagccgctggaccggagacctcaagaaagcaatcccacctcactgcttcaaacgctccatcccacgctccttctcctcttcgacatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45974 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttaccccgcctggcccctctacggggcctgccaaggctgcgtcctaacgggcctctgggtcatcgcccacgaatgcggccaccacgccttcagcgatac

SEQ ID NO: 45975 - DNA, 334 bp, Artificial
  Mutation in BnaC.FAD2.b introduced by TALE nuclease pair BnFAD2_T03
caggatccatgggtgcaggtggaagaatgcaagtctatcctccctccagctcccccggaaccaacaccctcaaacgcgtcccctgcgagacaccaccattcactctccctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45976 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacactccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 45977 - DNA, 311 bp, Artificial
  Mutation in BnaC.FAD2.b introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45978 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaacccccaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 45979 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 45980 - DNA, 347 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 45981 - DNA, 322 bp, Artificial
  Mutation in BnaC.FAD2.b introduced by TALE nuclease pair BnFAD2_T03
caggatccatgggtgcaggtcgaagaatgcaagtctctcccccctccagctcccccggacccaacaccctcaaacgcgtcccctgcgagacaccacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45982 - DNA, 378 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45983 - DNA, 334 bp, Artificial
  Mutation in BnaC.FAD2.b introduced by TALE nuclease pair BnFAD2_T03
caggatccatgggtgcaggtgaaagaatgcatgtctctccttcccccagctcccccgaaaccaaaaccctcaaccacgtcccatgcgagacaccaccattcactagacctcaagaaagcaatcccacctcactgcttcaaacgctccatcccacgcgccttctcctcttcgacatcatcatctcctcctcggctcctccctctaccacctctccccagcctacttccctcgcccttacctcgcctgacccctctactgggccggccaaggctgcgtccgaacgggcctctgggtcatagcccacgagtgcggccaccgcgccatcagcgactac

SEQ ID NO: 45984 - DNA, 348 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 45985 - DNA, 330 bp, Artificial
  Mutation in BnaC.FAD2.b introduced by TALE nuclease pair BnFAD2_T03
cagggatccatgggtgcaggtggaagaatgcaagtgtctcctccctccaaaaagtctgaaaccgacaacatcaagcgcgtaccctgcgagacaccgcccgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccatggctgcgtcctaacgggcctctgggtcatagcccacgagtgcggccaccacgccttcagcgactac

SEQ ID NO: 45986 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcttcctaacgggcctctgggtcatagcccacgagtgcggccaccacgccttcagcgactac

SEQ ID NO: 45987 - DNA, 349 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctccttctactacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45988 - DNA, 334 bp, Artificial
  Mutation in BnaC.FAD2.b introduced by TALE nuclease pair BnFAD2_T03
caggatccatgggtgcaggccaaagaatgcaagtctctcatccatccggctcccccggaaccaacaccctcaaacgcgtcccctgcgagacaccaccattcactctcgacctcaagaaagcaatcccacctcactgcttcaaacgctccatcccacgctccttctcctcttcgacatcatcatctcctcctcggctcctccctctaccacctccacagcctacttccctctcccttacctcgcctgacccctctactgggcctgccaaggctgcgtcctaacgggcctctgggtcatagcccacgagtgcggccaccacgccttcagcgactac

SEQ ID NO: 45989 - DNA, 342 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcgaccaccacgccttcagcgactac

SEQ ID NO: 45990 - DNA, 349 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcccacttccctctcctcccccaccctctcccttacctcgcctggcccctctactgggcctgccaaggctgcgtcctaaccggcgtctgggtcatagcccacgaatgcggccaccacgccttcagcgactac

SEQ ID NO: 45991 - DNA, 352 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtggagacctcaagaaagcaatcccacctcactccttcaaacgctccatcccccgctccttctcctacctcctcttcaacatcctcgtctcctcctccctctaccacctctccacagcctacttccctcacctcccccaccctcgcccttacctcgcctggcccctctactgggcctgccaaggctgcgtcctaacgggcctctgggtcatcgcccacgaatgcggccaccacgccttcagcgactac

SEQ ID NO: 45992 - DNA, 351 bp, Artificial
  Mutation in BnaC.FAD2.b introduced by TALE nuclease pair BnFAD2_T03
caggatccatgggtgcaggtggaagcatgcaagtctctcctccctccagctcccccggaaccaacaccctcaaacgcgtcccctgcgagacaccaccattcactcaagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 45993 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacacgtcccctgcgagacaccacccttcactcgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 45994 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgaactcaagaaagcaatcccacctcactgcttcaaacgctccatcccacgctccttctcctcttcgacatcatcatctcctcctcggctcctccctctactacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45995 - DNA, 333 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcagagcccacgagtgcggccaccacgccttcagcgactac

SEQ ID NO: 45996 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 45997 - DNA, 347 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 45998 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactgagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 45999 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgccttacccctctactgggcctgccaaggctgcgtcctaacgggcctctgggtcatagcccacgagtgcggccaccacgccttcagcgactac

SEQ ID NO: 46000 - DNA, 417 bp, Artificial
  Mutation in BnaC.FAD2.b introduced by TALE nuclease pair BnFAD2_T03
caggatccatgggtgcaggcggaagaatgcaagtgcctcatccctccaagaagtctgaaaccgacaacatcaagcgcgtaccctgcgagacaccgcccttcactgtccgactgggcctttcgttttatctgttgtttgtcggtgaacgctctcctgagtaggacaaatccggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 46001 - DNA, 337 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctcttcgacatcatcatctcctcctcggctcctccctctaccacctctccacagcctacttccctctcccttacctagcctgacccctctactgggcctgccaaggctgcgtcctaacgggcctctgggtcatagcccacgagtgcggccaccacgccttcagcgactac

SEQ ID NO: 46002 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 46003 - DNA, 322 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 46004 - DNA, 332 bp, Artificial
  Mutation in BnaC.FAD2.b introduced by TALE nuclease pair BnFAD2_T03
caggatccatgggtgcaggtagaagaatgcaagtctctcccccatccagctcccccgaacccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccagggctgcgtcctaacgggcctctggttcatcgcccacgaatgcggccaccacggcttcagcgactac

SEQ ID NO: 46005 - DNA, 337 bp, Artificial
  Mutation in BnaC.FAD2.b introduced by TALE nuclease pair BnFAD2_T03
caggatccatgggtgcaggtgaaagaatgcaagtctctccttccaccagctcccccggaaccaacaccctcaaacgcgtcccctgcgagacaccaccattcactctaagacctcaagaaagcaatcccacctcactgcttcaaacgctccatcccacgctccttctcctcttcgacatcatcatctcctcctcggctcctccctctaccacatctccacagcctacttccctctcccttacctcgcctgacccctctactgggcctgccaaggctgcgtcctaacgggcctcggggtcatagcccgcgagtgcggccaccacgccttcagcgactac

SEQ ID NO: 46006 - DNA, 335 bp, Artificial
  Mutation in BnaC.FAD2.b introduced by TALE nuclease pair BnFAD2_T03
caggatccatgggtgcaggcggaagaatgcaagtctctcctccctccagctcccccgaaaccaaaaccctcaaacgcgtcccctgcgagacaccacccttcactcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46007 - DNA, 345 bp, Artificial
  Mutation in BnaC.FAD2.b introduced by TALE nuclease pair BnFAD2_T03
caggatccatgggtgcaggtagaagaatgcaagtctctcctacctccagctcccccgaaaccaaaaccctcaaacgcgtcccctgcgagacaccacccttgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 46008 - DNA, 350 bp, Artificial
  Mutation in BnaC.FAD2.b introduced by TALE nuclease pair BnFAD2_T03
caggatcatgggtgcaggtgggagaatgcaagtcttttctccctccagctcccccggaaccaacaccctcaaacgcgtcccctgcgcgacaccaccattcactctagacctcaagaaagcaatcccacctcactgcttcaaacgctccatcccacgctccttctcctcttcgacatcatcatctcctcctcggctcctccctctaccacctctccacagcctacttccctctcctcccccaccctctccctcacctcgcctggcccctctactgggcctgccaaggctgcgtcctaacgggcctctgggtcagcacccacgaatgcggccaccacgccttcatcgactac

SEQ ID NO: 46009 - DNA, 349 bp, Artificial
  Mutation in BnaC.FAD2.b introduced by TALE nuclease pair BnFAD2_T03
caggatccatgggtgcaggtggaagaatgcaagtctctcctccctccagctccccctaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 46010 - DNA, 333 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46011 - DNA, 351 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaaactcaagaaagcaatcccaccgcactgtttcaaacgctcgatccctcgctctttctcctacctcatctgggacatcctcgtctcctcctccctctaccacctctccacagcctacttccctctcctcccccaccgtctcccttacctcgcctggcccctctactgggcctgccaaggctgcgtcctaacgggcctctgggtcatcgcccacgaatgcggccaccacgccttcagcgactac

SEQ ID NO: 46012 - DNA, 335 bp, Artificial
  Mutation in BnaC.FAD2.b introduced by TALE nuclease pair BnFAD2_T03
caggatccatgggtgcagggggaagaatgcaagtctatcttgcctccagctcccccggagccaacaacctcaaaagcgtcccctgcgacacaccaccattcactgagacctcaagaaagcaatcccacctcactgcttcaaacgctccatcccacgctccttctcctcttcgacatcatcatctcctcctcgactcctccctctaccacctctccacagcctacttccctctcccttacctcgcctgacccctctactgggcctgccacggctgcgtcctaacgggcctctgggtcatagcccacgagtgcggccaccacgccttcagcgactac

SEQ ID NO: 46013 - DNA, 350 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcagacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 46014 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcagccaccacgccttcagcgactac

SEQ ID NO: 46015 - DNA, 350 bp, Artificial
  Mutation in BnaC.FAD2.b introduced by TALE nuclease pair BnFAD2_T03
caggatccatgggtgcaggtggaagaatgcaagtctctcctccctccagctcccccggacccaacaccctcaaacgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 46016 - DNA, 411 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcctggcacagcaccggcaacagccgctggaccgtctccagcgcctgcttgccaccgccagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 46017 - DNA, 349 bp, Artificial
  Mutation in BnaC.FAD2.b introduced by TALE nuclease pair BnFAD2_T03
caggatccatgggtgcaggtagaagaatgcaagtctctcctccatccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcagcgcccacgaatgcggccaccacgccttcagcgactac

SEQ ID NO: 46018 - DNA, 347 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacaccacccttcactgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 46019 - DNA, 385 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggtgctgtgccaggcccacggcttgaccccccagcaggtggtggccatagacctcaagaaagcaatcccacctcactgcttcaaacgctccatcccacgctccttctcctcttcgacatcatcatctcctcctcggctcctccctctaccacctctccacagcctcctgccctctcccttacctcgcctgacccctctactgggcctgccaaggctgcgtcctaacgggcctctgggtcatagcccacgagtgcggccaccacgccttcagcgactac

SEQ ID NO: 46020 - DNA, 321 bp, Artificial
  Mutation in BnaC.FAD2.b introduced by TALE nuclease pair BnFAD2_T03
aggatccatgggtgcaggtggcagaatgcaagtctgcactacctccagctcccccggaaccaacaccctcacacgcgtcccctgcgagcggagacctcaagaaagcaatcccacctcactgctttaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46021 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgccagacctcaagaaagcaatcccacctcactgcttcaaacgctccatcccacgctccctctcctctccgacatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46022 - DNA, 329 bp, Artificial
  Mutation in BnaC.FAD2.b introduced by TALE nuclease pair BnFAD2_T03
caggatccatgggtgcaggtgtaagaatgcaagtgtctcctccctccagctcccccgaaaccaaaaccctcaaacgcgtcccctgcgagacaccatcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagctcacgagtgcggccaccacgccttcagcgactac

SEQ ID NO: 46023 - DNA, 333 bp, Artificial
  Mutation in BnaC.FAD2.b introduced by TALE nuclease pair BnFAD2_T03
caggatccatgggtgcaggtggaagaatgcaagtctatccaccatccagctcccccgaaaccaaaaccctcaaacgcgtcccctgcgagacaccacccttcactcaacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 46024 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggtcggagacctcaagaaagcaatcccacctcactgcttcaaacgctccatcccacgctccttctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46025 - DNA, 338 bp, Artificial
  Mutation in BnaC.FAD2.b introduced by TALE nuclease pair BnFAD2_T03
caggatccatgggtgcatgtggaagaatgcaagtctctcctccctccagctcccccggaaccaacaccctcaaacgcgtcccctgcgagacaccaccattcacttcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46026 - DNA, 329 bp, Artificial
  Mutation in BnaC.FAD2.b introduced by TALE nuclease pair BnFAD2_T03
caggatccatgggtgcaggtgaaagaatgcaagtctcacactcctccagctcccccgaaaccaaaaccatcaaccgcgtccccagcgagacaccaccattcactctcggaaagcaataccacctcactgctgcaaacgctccatcccacgctccttctcctcttcgacatcatcatctcctcctcggctcctccctctaccacctctccacagcctacttccctctcccttacctcacctgacccctctactgggcctgcctaggctgcttctgaatgggcctgtgggtcatatcctgcaagtgctgcgaccgcgccttgagcgactac

SEQ ID NO: 46027 - DNA, 343 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacacactcaaacgcgtcccctgcgagacaccaccattcactctagacctcaagaaagcaatcccacctcactgcttcaaacgctccatcccacgctccttctcctcttcgacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 46028 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacggagacctcaagaaagcaatcccacctcactgcttcaaacgctccatccctcgctccttctcctacctcctcttcgacatcctcgtctcctcctccctctaccacctctccacagcctacttccctctcccttacctcgcctggcccctctactgggcctgccaaggctgcgtcctaacgggcctctgggtcatcgcccacgaatgcggccaccacgccttcggcgactac

SEQ ID NO: 46029 - DNA, 416 bp, Artificial
  Mutation in BnaC.FAD2.b introduced by TALE nuclease pair BnFAD2_T03
caggatccatgggtgcaggtggaagaatgcaagtgtctcctacctccaagaagtctgaaaccgacaccatcaagcgcgtaccctgcgagacaccacccttcactccagcaatattggtggcaacgaacaggtcactatcagtcaaaataaaatcattatttgccatgtacgaagacctcaagaaagcaatcccacctcactgcttcaaacgctccatccctcgctccttctcctacctcctcttcgacatcctcgtctcctcctccctctaccacctctccaccgcctacttccctctcctcccccaccctctcccttacctcgcctggcccctctactgggcctgccaagcctgcgtcctaacgggcctctgggtcatcgcccacgaatgcggccaccacgccttcagcgactac

SEQ ID NO: 46030 - DNA, 331 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 46031 - DNA, 382 bp, Artificial
  Mutation in BnaC.FAD2.b introduced by TALE nuclease pair BnFAD2_T03
caggatccatgggtgcaggtggaagaatgcaagtctcacccccctccagctcccccggaaccaacaccctcaaacgcgtcccctgcgagacaccaccattcactactgacagaaccgcaacgttgaaggagccactcagccgcgggtttctgagacctcaagaaagcaatcccacctcactgcttcaaacgctccatcccacgctccttctcctcttcgacatcatcatctcctcctcggctcctccctctcccacctctccacagcctactcccctctcccttacctcgcctgacccctctactgggcctgccaaggctgcgtcctaacgggcctctgggtcatagcccacgagtgcggccaccacgccttcagcgactac

SEQ ID NO: 46032 - DNA, 347 bp, Artificial
  Mutation in BnaC.FAD2.b introduced by TALE nuclease pair BnFAD2_T03
caggatccatgggtgcaggtggaagaacgcaagtctctcctccctccagctcccccggaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 46033 - DNA, 398 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgacggatggcctttttgcgtttctacaaactcttcctggctagcggtacgcgtattaattgcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46034 - DNA, 323 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 46035 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatctcctcatcggctcctccctctaccacctctccacagcctacttccctctcccttacctcgcctggcctctctactgggactgccaagggtgcgtcctaaccggcgtctgggtcatagcccacgagtgcggccaccacgccttcagcgactac

SEQ ID NO: 46036 - DNA, 346 bp, Artificial
  Mutation in BnaC.FAD2.b introduced by TALE nuclease pair BnFAD2_T03
caggatccatgggtgcaggtggaagaatgcaagtgtctcctccctccaaaaagtctgaaaccgacaccatcaagcgcgtcccctgcgagacaccaccattcactccatcccacgctccttctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46037 - DNA, 335 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactgc

SEQ ID NO: 46038 - DNA, 317 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctggggcatagcccacgagtgcggccaccacgccttcagcgactac

SEQ ID NO: 46039 - DNA, 349 bp, Artificial
  Mutation in BnaC.FAD2.b introduced by TALE nuclease pair BnFAD2_T03
caggatccatgggtgcaggtggaagaatgcaagtctctcgtccctccagctcccccgaaaccaaaaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgaattcggcctccacgccttcagcgactac

SEQ ID NO: 46040 - DNA, 353 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggagacctcaagaaagcaatcccacctcactgcttcaaacgctccctcccacgctccttctcctcttcgacatcatcatctcctcctcggctcctccctctaccacctctccacagcctacttccctctcctcccccaccctctcccttccctcgcctggcccctctactgggcctgccaaggctgcgtcctaacgggcctctgggtcatagcccacgagtgcggccaccacgccttcagcgactac

SEQ ID NO: 46041 - DNA, 330 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacacctacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 46042 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 46043 - DNA, 336 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacaccatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46044 - DNA, 330 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaacactcaaacgcgtcccctgcgagacaccacccttgagacctcaagaaagcaatcccacctcactgcttcaaacgctccatccctcgctccttctcctacctcctcttagacatcctcgtctcctcctccctctaccacctctccacagcctacttccctctctcctacttcgcctggcctctctactgggcctgccagggctgcgtcctaaccggcgtctgggtcatagcccacgagtgcggccaccacgccttcagcgactac

SEQ ID NO: 46045 - DNA, 350 bp, Artificial
  Mutation in BnaC.FAD2.b introduced by TALE nuclease pair BnFAD2_T03
caggatccatgggtgcaagtggaagaatgcaagtctctcatccctccagctcccccgaaaccaacaccctcaaacgcgtcccctgcgagacaccacccttcactctcggcctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 46046 - DNA, 421 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgcaccggcaacagccgctggaccgtctccagcgcctgcttgccgccatcgtggctggcgatggccaccacctgaactcaagaaagcaatcccaccgcactgcttcaaacgctccatcccacgctccttctcctacctcctcttcgacatcctcgtctcctcccccctctaccccccctccacagcctacttccctctccccccccaccctctcccttacctcgcctggcccctctactgggcctgccaaggctgcgtcctaacgggcctctgggtcatcgcccacgaatgcggccaccacgccttcagcgactac

SEQ ID NO: 46047 - DNA, 334 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggccggccaaggctgcgtcctaacgggcctctgggtcatagcccacgagtgcggccaccacgccatcagcgactac

SEQ ID NO: 46048 - DNA, 324 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaatgacgcaatcccccatcacggcatcaaaccccccagctctcactccttctcctctcccacttcctcctatcctactcggctcctccctctaccacctctccacaacctccttccctctcccttacctcgcctgacccctctactgggcctgccaaggctgcgtcctaacgggcctctgggtcatagcccacgagtgcggccaccacgccttcagcgactac

SEQ ID NO: 46049 - DNA, 332 bp, Artificial
  Mutation in BnaC.FAD2.b introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcctcttcgacatcctcgtctcctcctccctctaccacctctccacagcctacttccctctcccttacttcgcctggcctctctactgggcctgccagggctgcgtcctaacgggcctctgggtcatcgcccacgaatgcggccaccacgccttcagcgactac

SEQ ID NO: 46050 - DNA, 348 bp, Artificial
  Mutation in BnaC.FAD2.b introduced by TALE nuclease pair BnFAD2_T03
caggatccatggggcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 46051 - DNA, 446 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaccgtctccagcgcctgcttgccgccatcgtggctggcgatggccaccacctgctccggggtcaagccgtgggcctggcacagcaccggcaacagccgctggaccgtcgccagcgcctgcttgccgccaagacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 46052 - DNA, 386 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctggcaacgctgcgatcatgtcctgatacttgacagcgacggtccctttcgcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46053 - DNA, 264 bp, Artificial
  Mutation in BnaC.FAD2.b introduced by TALE nuclease pair BnFAD2_T03
caggatccatgggtgcaggtggaagaatgcaagtctctcctccctccagcaatcccacctcactgcttccaaccctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46054 - DNA, 336 bp, Artificial
  Mutation in BnaC.FAD2.b introduced by TALE nuclease pair BnFAD2_T03
caggatccatgggtgcaggtgtaagaatgcaagtctctcctccatccagctcccccgaaaccaaaaccctcaaacgcgtcccctgcgagacaccacccttcactctgagacctcaagaaagcaatcccacctcactgcttcaaacgctccatccctcgctccttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46055 - DNA, 406 bp, Artificial
  Mutation in BnaC.FAD2.b introduced by TALE nuclease pair BnFAD2_T03
caggatccatgggtgcaggtgcaagaatgcaagtctctcctccctacagctcccccggaaccaacaccctcacacgcgtcccctgcgagacaccaccattcactctctccagcgcctgcttgccaccattattgctggcgatggccaccacctgctggggggcgacctcaagaaagcaatcccacctcactgcttcaaacgctccatccctcgctccttctcctacctcctcttcgacatcctcgtctcctcctcccgccaccacctctccacagcctactgccctcgcctcccccaccctctcccttacctcgcctggcccctctactgggcctgccaaggctgcgtcctaacgggcctctgggtcatcgccgacgaaggcggcctccacgccttcagcgactac

SEQ ID NO: 46056 - DNA, 350 bp, Artificial
  Mutation in BnaC.FAD2.b introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactctagacctcaagaaagcaatcccacctcactgcttcaaacgctccatccctcgctccttctcctacctcctcttcgacatcctcgtctcctcctccctctaccacctctccacagcatacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 46057 - DNA, 357 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcgggtgtggtggttacgtagacctcaagaaagcaatcccacctcactgcttcaaacgctccatcccacgccccttctcctcttcgacatcatcatctcctcctcggctcctctccctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46058 - DNA, 365 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggctctttatccgccaaaaaacccaccgctacctcaaaaaagcaatcccacctcactgcttcaaacgctccatcccacgctccttctcctcttcgacatcatcatctcctcctcggctcctccctctaccacctctccacagcctccttccctctcccttacctcgcctgacccctctactgggcctgccaaggctgcgtcctaacgggcctctgggtcatcgcccacgaatgcggccaccacgccttcagcgactac

SEQ ID NO: 46059 - DNA, 264 bp, Artificial
  Mutation in BnaC.FAD2.b introduced by TALE nuclease pair BnFAD2_T03
caggatccatgggtgcaggtgtaagaatgcaagtgtctcctccctccagctcccccggaaccaacaccctcaaacgcgtcccctgcgagacaccaccattcactcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46060 - DNA, 410 bp, Artificial
  Mutation in BnaC.FAD2.b introduced by TALE nuclease pair BnFAD2_T03
caggatccatgggtgcaggtggaagaatgcaagtctctcccccctccagctcccccggaaccaacaccctcaaacgcgtcccctgcgagacaccaccattcactagttgccggtgctgtgccaggcccacggcttgaccccccagcaggtggtggccatcgccagcagacctcaagaaagcaatcccacctcactgcttcaaacgctccatccctcgctccttctcctacctcctcttcgacatcctcgtctcctcctccctctaccacctctccacagcctacttccctctcccccccccccctctcccttacctcccctggcccctctactgggcctgccaaggctgcttcctaacgggcctctgggtcatcgcccacgaatgcggccaccacgccttcagcgactac

SEQ ID NO: 46061 - DNA, 336 bp, Artificial
  Mutation in BnaC.FAD2.b introduced by TALE nuclease pair BnFAD2_T03
catgatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 46062 - DNA, 352 bp, Artificial
  Mutation in BnaC.FAD2.b introduced by TALE nuclease pair BnFAD2_T03
caggatccatgggtgcaggtggaagaatgcaagtctctcatccctccagctcccccggaaccaacaccctcaaacgcgtcccctgcgagacaccaccattcactctcagacctcaagcaagcaatcccacctcactgcttcaaacgctccatcccacgctccttctcctcttcgacatcatcatctcctcctcggctcctccctctaccacctctccacagcctacttccctctcctcccccaccctcgcccttacctcgcctggcccctctactgggcctgccaagactgcgtcctaacgggcctctgggtcatcgcccacgaatgcggccaccacgccttcagcgactac

SEQ ID NO: 46063 - DNA, 343 bp, Artificial
  Mutation in BnaC.FAD2.b introduced by TALE nuclease pair BnFAD2_T03
caggatccatgggtgcaggtggaagaatgcaagtctctcctccatccagctcccccgaaaccaaaaccctcaaacgcgtcccctgcgagacatcatcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccaccaatgcggccaccacgccttcagcgactac

SEQ ID NO: 46064 - DNA, 351 bp, Artificial
  Mutation in BnaC.FAD2.b introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 46065 - DNA, 265 bp, Artificial
  Mutation in BnaC.FAD2.b introduced by TALE nuclease pair BnFAD2_T03
caggatccatgggtgcaggtacaagaatgcaagtctatcctccctccagtctctccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcatcgactac

SEQ ID NO: 46066 - DNA, 391 bp, Artificial
  Mutation in BnaC.FAD2.b introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggccatcgccagcaatggcggtggcaacagccgctggagacctcaagaaagcaatcccaccccactgcttccaacgctccatcccacgctccttctcctcttcgacatcatcatctcctcctcggctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 46067 - DNA, 350 bp, Artificial
  Mutation in BnaC.FAD2.b introduced by TALE nuclease pair BnFAD2_T03
caggatccatgggtgcaggtgcaagaatgcaagtctctcctccctacagctcccccgaaaccaaaaccctcaaacgcgtcccctgcgagacaccacccttcactctagacctcaagaaagcaaccccacctcactgcttcaaacgctccatccctcgctccttctcctacctcctcttcgacatcctcgtctcctcctccctctaccacctctccacagcctacttccctctcctcccccgccctctcccttacctcgcctggcccctctactgggcctgccaaggctgcgtcctaacgggcctctgggtcagcgcccacgagtgcggccaccacgccttcagcgactac

SEQ ID NO: 46068 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46069 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46070 - DNA, 356 bp, Artificial
  Mutation in BnaA.FAD2.a introduced by TALE nuclease pair BnFAD2_T05
cctctcctccctctccctctcccttacctcgcctggcccctctactgggcctgccaaggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 46071 - DNA, 419 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcggtacgcgtattaattgcgttgcgctcactgcccgcaaaaggccagcaaaaggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46072 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46073 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggtctcatcttccactccttcctcctcgtcccttacttctcctggaagtacagtcatcgacgccaccattccaacactggctccctcgagagagatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46074 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacaccaagtggtacggcaagtccctcaacaaccctttgggacgcacagtgatgttaacggttcagttcactctcggctgccctttgtccttag

SEQ ID NO: 46075 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46076 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 46077 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 46078 - DNA, 352 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggctggacgacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46079 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46080 - DNA, 355 bp, Artificial
  Mutation in BnaA.FAD2.a introduced by TALE nuclease pair BnFAD2_T05
cctctcctccctcaccctctctcctccttcgccttgcctctctactgagcctgccatggctgcgtcctaaccggcctctgggtcctagcccacgaaaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagaatctcagcaagcgtcagagacgtacagtggtctgcatggctcagttcactctcggctggcctttgtacttag

SEQ ID NO: 46081 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccagcgactaccagtggctggacgacaccgtcggcctcatcttccactccttcctcctcgtcccttacttctcctggaattacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46082 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46083 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46084 - DNA, 396 bp, Artificial
  Mutation in BnaA.FAD2.a introduced by TALE nuclease pair BnFAD2_T05
cctctcctccctcaccctctcccttacctcgcctggcctctctactgggccatcgccagcaataatggtggcaagcaggcgctggagacggtccagcggctgttgccggtgctgtgccaggcccacggcttgacccccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46085 - DNA, 318 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtccaaaccggcgtctgggtcatagcccacgagtgcgtcggcctcatcttccactccttcctcctcgtcccttacttctcctggaagtacagtcatcgacgccaccattccaacactggctccctcgagaaagacgaagtgtttgtccccaagaagaagtcagacatcaagtggtacggcaagtacctcaacaaccctttgggacgcaccgtgatgttaacggtgcagttcactctcggctgcctttgtacttag

SEQ ID NO: 46086 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacgccgtgtgcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 46087 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggctggacgacaccgtcggcctcatcttccactccttcctactcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46088 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46089 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattcaaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 46090 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46091 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46092 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46093 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46094 - DNA, 355 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46095 - DNA, 355 bp, Artificial
  Mutation in BnaA.FAD2.a introduced by TALE nuclease pair BnFAD2_T05
cctctcctccctcaccctctctcctacttcgcctggcctctctacttggcctgccaagggtgcgtcctaaccggcgtctgggtcatagcccacgagcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 46096 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46097 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46098 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 46099 - DNA, 424 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46100 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgaggttaacggttcagttccctctcggctggcctttgtacttag

SEQ ID NO: 46101 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 46102 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46103 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagttgtacggcaagtacctcaacaaccgtttgggacgcaccgtgatgttaaccgtccagttcacgctcggctggcatttgtacgtag

SEQ ID NO: 46104 - DNA, 344 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46105 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgccggcctcgtcttccactccttcctcctcgtcccttacttctcctggaagtacagtcatcgacgccaccattccaacactggctccctcgagagagacgaagtttttgtccccaagaagaagtcagacatcaagtggtacggcaagtacctcaacaaccctttgggacgcaccgtgatgttaacggttcagttcactcccggctggcctttgtacttag

SEQ ID NO: 46106 - DNA, 353 bp, Artificial
  Mutation in BnaA.FAD2.a introduced by TALE nuclease pair BnFAD2_T05
cctctcctccctcaccctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaactacctcaacaaccctttgggacgccccgtgatgttaacggttcagttcactatcggctgccctttgtacttag

SEQ ID NO: 46107 - DNA, 358 bp, Artificial
  Mutation in BnaA.FAD2.a introduced by TALE nuclease pair BnFAD2_T05
cctctcctccctcaccctctctcctacttcgcctggcctctctactggtcctgccatggctgcgtcctaaccggcgtctgggtcatagcccacgagtgccaccacgccttcagcgaccaccagtggctggacgacgccgccggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaaaaaccctgagggacgcaacgtgatgttaacggttcagttcactctcggctggcctttgtacttag

SEQ ID NO: 46108 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttacttag

SEQ ID NO: 46109 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcctcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46110 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46111 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 46112 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46113 - DNA, 333 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46114 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgctgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46115 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46116 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46117 - DNA, 348 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgccaccacgccttcagcgaccaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46118 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46119 - DNA, 449 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgttcttcatgaaggtgtacggctacaggggcaagcacctgggcggctccaggaagcccgacggcgccatctacaccgtgggctcccccatccaccacgccttcagcgactaccagtggctggacgacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46120 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46121 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46122 - DNA, 443 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgttaacggttcagttcactctcggctggcctttgtacttag

SEQ ID NO: 46123 - DNA, 402 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46124 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 46125 - DNA, 346 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46126 - DNA, 396 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaggtggtggccatcgccaccacctgctccgccgctggaccgtctccgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46127 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46128 - DNA, 443 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcctcaagccgtgggcctggtccagcggctgttgccaccgccattgctggcgatggccaccacctgctggggggtcaagccgtgtgccaccacgccttcagcgactaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46129 - DNA, 480 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgctggtggccatcgccagccacgatggcggcaagcaggcgctggagacggtccagcggctgttgccggtgctgtgccaggcccacggcttgaccccccagcaggtgggggccatcgccagcaatacaccacgccttcagcgactaccaggggccggaccacaccgtcggcctcatcttcccctcctccctcctcgtcccttacttctcctggaagtacagccatcgacgccaccattccaaccccggatccctcgagagggatgaagtgttcgtccccaagaagaagtcagacatcaagtggtacggcaagtacctcaacaaccctttgggacgcaccgtgatgttaacggttcagttcactctcggctgcctttgtacttag

SEQ ID NO: 46130 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaggtacctcaacaaccgtttgggacgcaccgtgatgttaaccgtccagttcacgcccggctggcctttgtacttag

SEQ ID NO: 46131 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46132 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacactgactccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 46133 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46134 - DNA, 353 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46135 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttcaactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46136 - DNA, 467 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccatcgccagcaatattggtggcaagcaggcgctggagacggtccagcggctgttgccggtgctgtgccaggcccacggcttgaccccccagcaggtggtggccatccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46137 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46138 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgacaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46139 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46140 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46141 - DNA, 430 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgcggatggcctttttgcttttctacaaactcttcctggctagcggtacgcgtattaattgcgttgcgctcgccaccacgccttcagcgactaccagtggctggacgacaccgtcggcctcatcttccactccttcctcctcgtcccttacttctcctggaagtacagtcatcgacgccacccttccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 46142 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 46143 - DNA, 364 bp, Artificial
  Mutation in BnaA.FAD2.a introduced by TALE nuclease pair BnFAD2_T05
cctctcctccctcaccctctcccttacctcgcctggcccctctactgggactgccaaggctgcgtcctaacgggcctctgggtcatcgcccacgaatgcggctgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtatctcaacaaccctttggtacgtaccggaatgttaacggttcagttcactctcggctggcctttgtacttag

SEQ ID NO: 46144 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46145 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 46146 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46147 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactgccagtggctggacgacaccgtcggcctcatcttccactccttcctcctcgtcccttacttctcctggaagtacagccatcgacgccaccattccaacaccggatccctcgagagggatgaagtgttcgtccccaagaagaaggcagacatcaagtggtacggcaagtacctcaacaaccctttgggacgcaccgtgatgttaacggttcagttcactctcggctggcctttgtacttag

SEQ ID NO: 46148 - DNA, 345 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46149 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcaccctcggctggcctttgtacttag

SEQ ID NO: 46150 - DNA, 360 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctttgtacttag

SEQ ID NO: 46151 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46152 - DNA, 363 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacacaccgtgatgttaacggttcagttcactctcggctggcctttgtacttag

SEQ ID NO: 46153 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 46154 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46155 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 46156 - DNA, 362 bp, Artificial
  Mutation in BnaA.FAD2.a introduced by TALE nuclease pair BnFAD2_T05
cctctcctccctcaccctctctcctacttcgcctggcatctctaatgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgccccgtgatgttaacggctcaggtcactctcgtatggcctttgtacttag

SEQ ID NO: 46157 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46158 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccatggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46159 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46160 - DNA, 280 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46161 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccacaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46162 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46163 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46164 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacagccgtttgggacgcaccgtgatgttaacggttcagttcactctcggctggcctttgtacttag

SEQ ID NO: 46165 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46166 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccggccaggtcacgctcggctggcctttgtacttag

SEQ ID NO: 46167 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46168 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttat

SEQ ID NO: 46169 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46170 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46171 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagggatgaagtgtccgtccccaagaagaagtcagacatcaagtggtacggcaagtacctcaacaaccctttgggacgcaccgtgatgttaacggttcagttcactctcggctggcctttgtacttag

SEQ ID NO: 46172 - DNA, 360 bp, Artificial
  Mutation in BnaA.FAD2.a introduced by TALE nuclease pair BnFAD2_T05
cctctcctccatcaccctctctcctacttcgcctggcctctctactgggcctgccagggctgcgtcctaaccggcgtctgggtcatagcccacgagtgcgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 46173 - DNA, 443 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgcctaaagccgtgggcctggtccagcggctgttgccaccgccattgctggcgatggccaccacctgctggggggtcaagccgtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctgagtacttag

SEQ ID NO: 46174 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46175 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46176 - DNA, 480 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggcaggcgctggagacggtccagcggctgttgccggtgctgtgccaggcccacggcttgaccccccagcaggtggtggccatcgccagcaataatggtggcaagcaggcgctggagacggtcccgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46177 - DNA, 394 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctcctggaagtacagccatcgacgccaccattccaacaccggctccctcgagagagacgaagtgtttgtccccaagaagaagtcagacatcaagtggtacggcaagtacatcaacaaccctttgggtcgcaccgtgatgttaacgtttcatttcactctcgtctggcatttatacttag

SEQ ID NO: 46178 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46179 - DNA, 329 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46180 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46181 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccttggtacttag

SEQ ID NO: 46182 - DNA, 403 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcaggtggtggccatcgccagcaataatggtggcaagcaggcgctggagaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46183 - DNA, 350 bp, Artificial
  Mutation in BnaA.FAD2.a introduced by TALE nuclease pair BnFAD2_T05
cctctcctccctcaccctctcacttacctcgcctggcacctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46184 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46185 - DNA, 440 bp, Artificial
  Mutation in BnaA.FAD2.a introduced by TALE nuclease pair BnFAD2_T05
cctctcctccctcaccctctctcctacttcgcctggcctctctactgagcctgccaagggtgcgtcctaaccggcgtctgggtcatagcccacgagaagactgagcctttcgttttatttgatgcctggcacagcaccggcaacagccgctggaccgtctccagcgcctgcttgccaccgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagggtttgtccccaagaagaaatccgacatcaagtggtacggaaagtacctcaacaacccgctaggacgcacggtgaggctaaccgtccagttcaggctcggctggcctttgtacttag

SEQ ID NO: 46186 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46187 - DNA, 432 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcacccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46188 - DNA, 344 bp, Artificial
  Mutation in BnaA.FAD2.a introduced by TALE nuclease pair BnFAD2_T05
cctctcctccctcaccctctctcctacctcgcctggcctctctactgggcctgccaaggctgcgtcctaaccggcgtctgggtcatagcccacgagtgcgtatgtcaactggctggacgacaccggcggtcgcatcttccactccttcctcctcgtcccttacttctcctggaagtacagtcatcgacgccaccattccaacacgggctccctcgagagagacgaagtgtttgtccccaagaagaagtcagacatcaagtggtacggcaagtacctcaacaaccctctgggacgcacagtgatgttaacggttcagttcacgctcggctggcctttgtacttag

SEQ ID NO: 46189 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 46190 - DNA, 361 bp, Artificial
  Mutation in BnaA.FAD2.a introduced by TALE nuclease pair BnFAD2_T05
cctctcctcctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46191 - DNA, 401 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46192 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46193 - DNA, 353 bp, Artificial
  Mutation in BnaA.FAD2.a introduced by TALE nuclease pair BnFAD2_T05
cctctcctccctcaccctctcccctacttcgcctggcctctctaatgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaggcagacatcaagtggtacggcaaggacctcaacaaccctttgggacgcaccgttatgttaacggttcaggtctctctcggctgtcctttatacttag

SEQ ID NO: 46194 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46195 - DNA, 358 bp, Artificial
  Mutation in BnaA.FAD2.a introduced by TALE nuclease pair BnFAD2_T05
cctctcctccctcaccctctctcctacttcgcctgccctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 46196 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtaatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46197 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46198 - DNA, 344 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46199 - DNA, 330 bp, Artificial
  Mutation in BnaA.FAD2.a introduced by TALE nuclease pair BnFAD2_T05
cctcttctccctcaccctctctcctacttcgcctggcctctctcctgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaaaaaccctttgggacgcaccgtgaggttaacggtgcagttcactctcggcgggccttggtacttag

SEQ ID NO: 46200 - DNA, 471 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcttggcgatggcaagcaggcgctggagacggtccagcggctgttgccggtgctgtgccaggcccacggcttgaccccccagcaggtggtggccatcgccagcaataatggtggcaagcaggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46201 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagttcctcaacaacccgctaggacgcatggtgatgctaaccggccatttcacgctcggctggcctttgtacttag

SEQ ID NO: 46202 - DNA, 358 bp, Artificial
  Mutation in BnaA.FAD2.a introduced by TALE nuclease pair BnFAD2_T05
cctctcctccctcaccctctcccttacctcgcctggcccctctcctgggcctgccaaggctgcgtcctaacgggcctctgggtcatcgcccacgaatgccaccacgccttcagcgaccaccagtggctggacgacgccatgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 46203 - DNA, 287 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46204 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggcgggcctttgtacttag

SEQ ID NO: 46205 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46206 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46207 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaaaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46208 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggcttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaacccttggggacgcaccgtgatgttaacggttcagttcactctcggctggcctttgtacttag

SEQ ID NO: 46209 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46210 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46211 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46212 - DNA, 281 bp, Artificial
  Mutation in BnaA.FAD2.a introduced by TALE nuclease pair BnFAD2_T05
cctctcctccctcaccctctcccttaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtctta

SEQ ID NO: 46213 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcagggtgatgctaaccggccagttcacgctcggctggcctttgtacttag

SEQ ID NO: 46214 - DNA, 319 bp, Artificial
  Mutation in BnaA.FAD2.a introduced by TALE nuclease pair BnFAD2_T05
cctctcctccctcaccctctcacctacttcgcctggcatctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46215 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggctggacgacaccgtcgtcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccctgatgttaacggttcagttcactctcggctggcctttgtacttag

SEQ ID NO: 46216 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46217 - DNA, 350 bp, Artificial
  Mutation in BnaA.FAD2.a introduced by TALE nuclease pair BnFAD2_T05
cctctcctccctcaccctctctcctacttcgcctggcatctctcctgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacgttgcatgtcactctcggctggcctgtgtacttag

SEQ ID NO: 46218 - DNA, 328 bp, Artificial
  Mutation in BnaA.FAD2.a introduced by TALE nuclease pair BnFAD2_T05
cctctcctccctcaccctctctcctacttcgcctggactctctactgggcctgccagggctgcgtcctaaccggcgtctgtgtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46219 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46220 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaaaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46221 - DNA, 355 bp, Artificial
  Mutation in BnaA.FAD2.a introduced by TALE nuclease pair BnFAD2_T05
cctcccctccctcaccctctctcctacttcgcctggcctatctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacgtttatgctaactgtccagttcacgctcggctggcctttgtacttag

SEQ ID NO: 46222 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtcttggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46223 - DNA, 358 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46224 - DNA, 333 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46225 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccactagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46226 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 46227 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46228 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46229 - DNA, 383 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46230 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46231 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46232 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46233 - DNA, 393 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgatggccaccacctgctgggggtcaagccgtgggccttgaccccgtcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 46234 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46235 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 46236 - DNA, 480 bp, Artificial
  Mutation in BnaA.FAD2.a introduced by TALE nuclease pair BnFAD2_T05
cctctcctccctcaccctctctcctacttcgcctggcctctctactggacctgccagggctgcgtcctaaccggcgtctgggtcatagcccacgagtggcaggcgctggagacggtccagcggctgttgccggtgctgtgccaggcccccggcttgacccccccgcaggtggtggccatcgccagcaataatggtggcaagcaggcgctggagacggtccagaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgaggctaaccgtccagttcacgctcggctggcctttgtacttag

SEQ ID NO: 46237 - DNA, 355 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 46238 - DNA, 358 bp, Artificial
  Mutation in BnaA.FAD2.a introduced by TALE nuclease pair BnFAD2_T05
cctctcctccctcaccctctctcctacttcttctggcctctctactgttcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtccgtctattcccccaccacccctgaggtacgcaccgtgatgttaccgctcccgttcactctcggctggcctttgtacttag

SEQ ID NO: 46239 - DNA, 330 bp, Artificial
  Mutation in BnaA.FAD2.a introduced by TALE nuclease pair BnFAD2_T05
cctctcctccctcaccctctctcctacttcgcctggactctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccaggtcacgctcggctggcctttgtacttag

SEQ ID NO: 46240 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 46241 - DNA, 432 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcaacgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaaccctttgggacgcaccgtgatgttaacggttcagttcacgctcggctggcctttgtacttag

SEQ ID NO: 46242 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaaaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46243 - DNA, 443 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgacccccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46244 - DNA, 449 bp, Artificial
  Mutation in BnaA.FAD2.a introduced by TALE nuclease pair BnFAD2_T05
cctctcctccctcaccctctatcctacttcgcctggcctctctactgggcctgccagggctgcgccctaaccggcgtctgggtcatagcccacgagtgcagggattttggtcatgggtggctcgagggctatttgccgactaccttggtgatctcgcctttcacgtagtggacaaattctttcaactggccaccacgcctaccccgcctaccagtggctggacgacaccgtcagcctcatcttacactccttccacctcgtccctatcttctcctggaagtacaatcatcgacgccaccatcccaaaactggctccctcgagagcgacgaagtgtttgtccccaagaagaagtcagacatcaactagtacgacaggtgccacagcaagcctctggaacgccccgtgaggttaacggttcagttcactctcgcctgcccttagtacctag

SEQ ID NO: 46245 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 46246 - DNA, 359 bp, Artificial
  Mutation in BnaA.FAD2.a introduced by TALE nuclease pair BnFAD2_T05
cctctcctccctcaccctctctcctacttcgcctggcatctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgggatgttaacgtttcatttcactctcggctggcctttgtacttag

SEQ ID NO: 46247 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggcttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46248 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggaaagtacctcaacaacccgctaggacgcacggtgatgctaaccgtccaggtcacgctcggctggcctttgtacttag

SEQ ID NO: 46249 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46250 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46251 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46252 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46253 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 46254 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttatagttag

SEQ ID NO: 46255 - DNA, 358 bp, Artificial
  Mutation in BnaA.FAD2.a introduced by TALE nuclease pair BnFAD2_T05
cctctcctccctcaccctctccattacctcgcctggcccctctactgggcctgccaaggctgcgtcctaacgggcctctgggtcatcgcccacgaatgcggaccacgcctcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46256 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 46257 - DNA, 443 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcctcaagccgtgggcctggtccagcggctgttgccaccgccattgctggcgatggccaccacctgctggggggtcaagccgtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46258 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagcgactaccagtggctggacgccaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 46259 - DNA, 383 bp, Artificial
  Mutation in BnaA.FAD2.a introduced by TALE nuclease pair BnFAD2_T05
cctctcctccctcaccctgtctcctacttcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtcgtacggcaagtaccccaacacccctttgggccgcgccgtgattttaacggttcagttcactcccggctggcctttgtacttag

SEQ ID NO: 46260 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcctctgggtcatcgcccacgaatgccaccaccacttcagcgactaccagtggcgggacgacgccgtcggcctcatcttccactccttcctcctcgtcccttacttctcctggaagtacagccatcgacgccaccattccaacaccggctccctcgagagagacgaagtgtttgtccccaagaagaaatcagacatcaagtggtacggcaagtacctcaacaacccgttgggacgcacggtgatgttaacggttcagttcacgctcggctggcctttgtacttag

SEQ ID NO: 46261 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46262 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46263 - DNA, 355 bp, Artificial
  Mutation in BnaA.FAD2.a introduced by TALE nuclease pair BnFAD2_T05
cctctcctccctcacctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46264 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagtgagacgaagtgtttgtccccaagaagaagtcagacatcaagtggtacggcaagtacctcaacgacccttagggacgcaacgtgatgttaacggttcagttcactctcggctggcctttgtacttag

SEQ ID NO: 46265 - DNA, 358 bp, Artificial
  Mutation in BnaA.FAD2.a introduced by TALE nuclease pair BnFAD2_T05
cctctcctccctcaccctctaccttacctcgcctggcccctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46266 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagccctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 46267 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttatacttag

SEQ ID NO: 46268 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccatacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46269 - DNA, 352 bp, Artificial
  Mutation in BnaA.FAD2.a introduced by TALE nuclease pair BnFAD2_T05
cctctcctccctcaccctctctactacttcgcctggcctctctactgcgcctgccaagggtgcgtcctcaccagcgtctgcgtcataacccacgaccacgccttcagcgactaccagtggctggacgacaccgtcggcctcatcttccactccttcctcctcttcccttacttctcctggaagtacagtcatcgacgccaccattccaacccgggctccctcgagagagacgaagtgtttctccccaataagaagtctggcatcaagtgatacggcgagtacctcaacaacccttttggaggcaccgtgaggtgaacggttcagttcacgctcggccggccttagtaattag

SEQ ID NO: 46270 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatcgcccacgccttcagcgaccaccagtggctggacgacgccgtgggcctcgtcttccactccttcctcctcgtcccttacttctcctggaagtacagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46271 - DNA, 359 bp, Artificial
  Mutation in BnaA.FAD2.a introduced by TALE nuclease pair BnFAD2_T05
cctctcctccctcaccctctcccttacctcgcctggcccctctactgggcctgcaagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtcaccaagaagaagtcagacatcaagtggtacggcaagtacctcaacaaccctttgggacgcaccgtgatgttaacggttcagttcactctcggctggcctttgtacttag

SEQ ID NO: 46272 - DNA, 349 bp, Artificial
  Mutation in BnaA.FAD2.a introduced by TALE nuclease pair BnFAD2_T05
cctctcctccctcaccctctctcctacttcgccttgcctctctactgggcctgccagggctgcgtcctaaccggcgtctgggtcatcgcccaccacgccttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaacccgttgggacgcaccgtgatgttaacggttcagttcactctcggctggcctttgtacgtag

SEQ ID NO: 46273 - DNA, 282 bp, Artificial
  Mutation in BnaA.FAD2.a introduced by TALE nuclease pair BnFAD2_T05
ctctcctccctcaccctctcccttaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46274 - DNA, 353 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46275 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46276 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46277 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46278 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46279 - DNA, 350 bp, Artificial
  Mutation in BnaA.FAD2.a introduced by TALE nuclease pair BnFAD2_T05
cctctcctccctcaccctctctcctacttcgcctagcctctctcctaggcctgccagggctgcgtcctaaccggcgtctgggtcatctcccaaccacgccttcagcgactaccagtggctgtacgacaccgtcggcctcatcttccactccttcctcctcgtcccttacttctcctggaagtacagtcatcgacgccaccattccaaccctggctccctcgagagagacgaagtgtttgtccccaagaagaaggcagacatcaagtggtacggcaagtacctcaacaaccctttgggacgcaccgtgatggtaacggttcagttcactctcggctggccttggtacttag

SEQ ID NO: 46280 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46281 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46282 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46283 - DNA, 355 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgaaaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46284 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46285 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcatcccttacttctcctggaagtacagtcatcgacgccaccattccaacactggctccctcgagagagacgaagtgtttgtccccaagaagaggtcagacatcaggtggtacggcaagtaccgcaacaaccgttggggacgcacggtgatgttaacggttcagttcactctcggctggcctttgtacttag

SEQ ID NO: 46286 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46287 - DNA, 329 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46288 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 46289 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 46290 - DNA, 358 bp, Artificial
  Mutation in BnaA.FAD2.a introduced by TALE nuclease pair BnFAD2_T05
cctctcctccctcaccctctcccttacctcgcctggcccctctactgagcctgccaaggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 46291 - DNA, 333 bp, Artificial
  Mutation in BnaA.FAD2.a introduced by TALE nuclease pair BnFAD2_T05
cctctcctccctcaccctctctcctacttcgcctggcctttctactaggcctgagcaggttattgctggggggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46292 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaagtcggacatcaagtggtacggcaagtacctcaacaaccctttgggacgcactgtgatgttaacggttcatttcactctcggctggcctttgtacttag

SEQ ID NO: 46293 - DNA, 331 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccctttgtacttag

SEQ ID NO: 46294 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttcctctccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46295 - DNA, 438 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaacgatgttacgcagcagggcagtcgccctaaaacaaagttaaacattatgagggaagcggtgatcgccgaagtatcgactaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46296 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46297 - DNA, 480 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtggcaggcgctggagacggtccagcggctgttgccggtgctgtgccaggcccacggcttgaccccccagcaggtggtggccatcgccagcaatggcggtggcaagcaggcgctggagacggtcccgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46298 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46299 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaccccgctaggacgcacggtgatgctaaccgtccagttcacgcccggctggcctttgtccttag

SEQ ID NO: 46300 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46301 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46302 - DNA, 349 bp, Artificial
  Mutation in BnaA.FAD2.a introduced by TALE nuclease pair BnFAD2_T05
cctctcctccctcaccctctctcctacttcgcctagcctctctactgggcctgccaagggtgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46303 - DNA, 360 bp, Artificial
  Mutation in BnaA.FAD2.a introduced by TALE nuclease pair BnFAD2_T05
cctctcctccctcaccctctctaatacttcgcctggcctctctactgggcctgccagggctgcgtcctaaccggcgtctgggtcatagcccacgagtgcggcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46304 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 46305 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46306 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcacacgccttcagcgactaccagtggctggacgccaccgtcggcctcatcttccactccttcctcctcgtcccttacttctcctggaagtacagtcatcgacgccacccttccaacactggctccctcgagagagacgaagtgttcgtccccaagacgaagtcacacctcacgtggtacggcaagtacctcaacatccctttgggccgccccgtgatgttaacggttcaattccctcccggctggcctttgtacttag

SEQ ID NO: 46307 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctttgtacttag

SEQ ID NO: 46308 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46309 - DNA, 396 bp, Artificial
  Mutation in BnaA.FAD2.a introduced by TALE nuclease pair BnFAD2_T05
cctctcctccctcaccctctctcctacatcgcctggcctctctactgggccatcgccagcaataatggtggcaagcaggcgctggagacggtccagcggctgttgccggtgctgtgccaggcccacggcttgacccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46310 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctcaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 46311 - DNA, 355 bp, Artificial
  Mutation in BnaA.FAD2.a introduced by TALE nuclease pair BnFAD2_T05
cctctcctccctcaccctctctcctacttcgcctggcctctctactgcgcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagtgcactctcggcttgcctttgtacttag

SEQ ID NO: 46312 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46313 - DNA, 403 bp, Artificial
  Mutation in BnaA.FAD2.a introduced by TALE nuclease pair BnFAD2_T05
cctctcctccctcaccctctctcctacttcgcctggcctctctactgtgcctgccagggctgcgtcctaaccggcgtctgggtcatagcccacgagcaggtggtggccatcgccagcaataatggtggcaagcaggcgctggagaaccacgccttcagcgactaccagtggctggacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtcccgttcacgctcggctggcctttgtacttag

SEQ ID NO: 46314 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtaatcgcccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46315 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46316 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 46317 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 46318 - DNA, 358 bp, Artificial
  Mutation in BnaA.FAD2.a introduced by TALE nuclease pair BnFAD2_T05
cctctcctccctcaccctctatcctacttcgcctggcctctctactgcgcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttggacttag

SEQ ID NO: 46319 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46320 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggccttggtacttag

SEQ ID NO: 46321 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46322 - DNA, 355 bp, Artificial
  Mutation in BnaA.FAD2.a introduced by TALE nuclease pair BnFAD2_T05
cctctcctccctcaccctctctactacttcgcctggcctctctactgcgcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggccgttgtacttag

SEQ ID NO: 46323 - DNA, 348 bp, Artificial
  Mutation in BnaA.FAD2.a introduced by TALE nuclease pair BnFAD2_T05
cctctcctcactcaccctctctcctacttcgcctggcctctctactgggcctgccaaggctgcgtcctaacgggcctctgggtcatcgccaccacgccttcagcgaccaccagtggccggacgacgccgtcggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46324 - DNA, 449 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgttcttcatgaaggtgtacggctacaggggcaagcacctgggcggctccaggaagcccgacggcgccatctacaccgtgggctcccccatccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46325 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46326 - DNA, 359 bp, Artificial
  Mutation in BnaA.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46327 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46328 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46329 - DNA, 432 bp, Artificial
  Mutation in BnaA.FAD2.a introduced by TALE nuclease pair BnFAD2_T05
cctctcctccctcaccctctaccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttcgtacttag

SEQ ID NO: 46330 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgccctaaccggcgtctgggtcatagcccacgagtgcggcccacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagttcctcagcaaccctctggggcgcacagtggtgttaaccgtccagttcaccctcggctggcctttgtacttag

SEQ ID NO: 46331 - DNA, 342 bp, Artificial
  Mutation in BnaA.FAD2.a introduced by TALE nuclease pair BnFAD2_T05
cctctcctccctcaccctctctcctacttcgccttgcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46332 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaacccgacatcaagtggtacggaaagtacctcagcaacccgctaggacgcacggtgatgctaaccgtccagttcacgctcggctggcctttgtacttag

SEQ ID NO: 46333 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggatggcctttgtaattag

SEQ ID NO: 46334 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46335 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46336 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46337 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcaggtcactctcggctggccgttgtacttag

SEQ ID NO: 46338 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46339 - DNA, 358 bp, Artificial
  Mutation in BnaA.FAD2.a introduced by TALE nuclease pair BnFAD2_T05
cctctcctccctcaccctctctactacttcgcctggcctctctcctgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46340 - DNA, 430 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgcggatggcctttttgcgtttctacaaactcttcctggctagcggtacgcgtattaattgcgttgcgctcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46341 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46342 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccacggctgcgtcctaaccggcgtctgggtcatagcccacgagtaccacgccttcagcgactaccagttgctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46343 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 46344 - DNA, 358 bp, Artificial
  Mutation in BnaA.FAD2.a introduced by TALE nuclease pair BnFAD2_T05
cctctcctccctcaccctctctcctacttcgcctggcctctctactgggcctgcccagggtgcgtcctaaccggcgtctgggtcatagcccacgagtgccaccactccttcagcgcctaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgccccgtgaggttaacggttcagttcacgctcggctggcctttgcacctag

SEQ ID NO: 46345 - DNA, 393 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgatggccaccacctgctggggggtcaagccgtgggccttgaccccgtcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttttacttag

SEQ ID NO: 46346 - DNA, 355 bp, Artificial
  Mutation in BnaA.FAD2.a introduced by TALE nuclease pair BnFAD2_T05
cctctcctccctcaccctctctcctacttctcctggcctccttactgggattgccagggctgcgccctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccccaacacgccagagggacgcaacataatgttaccggtcccgctccctctcggctggcctttgtacttag

SEQ ID NO: 46347 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46348 - DNA, 396 bp, Artificial
  Mutation in BnaA.FAD2.a introduced by TALE nuclease pair BnFAD2_T05
cctctcctccctcaccctctctcctacttcgcctggcctctctactgggccatcgccagcaataatggtggcaagcaggcgctggagacggtccagcggctgttgccggtgctgtgccaggcccacggcttgacccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46349 - DNA, 450 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcggctgttgccggtgctgtgccaggcccacggcttgaccccccgctccggggtctggccatcgccagccacgatggcggcaacagccgctggacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46350 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 46351 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46352 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 46353 - DNA, 446 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcggctgttgccggtgctgtgccaggcccacggcttgaccacggcttgaccccggagcaggtggtggccatcgccagcaatattggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 46354 - DNA, 419 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46355 - DNA, 447 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaggcccacggcttgaccccggagcaggtggtgcaattaatacgcgtaccgctagccaggaagagtttgtagaaacgcaaaaaggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46356 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgttgttaacggttcagttcactctcggctggcctttgtacttag

SEQ ID NO: 46357 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgcgtcatcgcccacgaatgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46358 - DNA, 359 bp, Artificial
  Mutation in BnaA.FAD2.a introduced by TALE nuclease pair BnFAD2_T05
cctctcctccctcaacctctcccttacctcgcctggcccctctactgggcctgccaaggctgcgtcctaacgggcctctgcgtcatcgcccacgaatgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtccctcaacaaccctttgggacgcaccgtgatgttaccggttcagttcactctcgcctggcctttgtacttag

SEQ ID NO: 46359 - DNA, 349 bp, Artificial
  Mutation in BnaA.FAD2.a introduced by TALE nuclease pair BnFAD2_T05
cctctcctccctcaccctctctcctacttcgcctggcctctctactgggcctgcaaagggtgcgtcctaaccggcgtctgggtcatagcccaccacgctttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 46360 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatcagacatcaagtggtacggcaagtacctcaacaaccctgtgggacgcaccgtgatgttaacggttcagttcactctcggctggcctttgtacttag

SEQ ID NO: 46361 - DNA, 383 bp, Artificial
  Mutation in BnaA.FAD2.a introduced by TALE nuclease pair BnFAD2_T05
cctctcctccctcaccctctctcctacttcgcctggcctctctactgcgcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46362 - DNA, 471 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcttggcgatggcaagcaggcgctggagacggtccagcggctgttgccggtgctgtgccaggcccacggcttgaccccccagcaggtggtgtccatcgccagcaataatggtggcaagcaggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 46363 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46364 - DNA, 340 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaaccggcgtctgggtcatagcccacgagtgctaccagtggcttgacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46365 - DNA, 444 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagatcaatgtcgatcgtggctggctcgaagatacctgcaagagtctcatattcactctcaatccaaataatctgcaccggatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46366 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46367 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgcgatgttaacggttcagttcactctcggctggcctttgtacttag

SEQ ID NO: 46368 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46369 - DNA, 438 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccattgctggcgatggccaccacctgctccggggtcaagccgtgggcctggcacagcaccggcaacagccgctggagagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46370 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcctccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46371 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46372 - DNA, 353 bp, Artificial
  Mutation in BnaA.FAD2.a introduced by TALE nuclease pair BnFAD2_T05
cctctcctccctaccctctctcctacttcgcctggcctctctactgggcctgccagggctgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46373 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 46374 - DNA, 390 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaagcggtgatcgccgaagtatcgactcagctatcagaggtagttggcgtcatcgagcgccatccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46375 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46376 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctctgggacgcaccgtgatgttaaccgttcagttcactctcggctggcctttgtacttag

SEQ ID NO: 46377 - DNA, 357 bp, Artificial
  Mutation in BnaA.FAD2.a introduced by TALE nuclease pair BnFAD2_T05
cctctcctccctcaccctctctcctacttcgcctggcctctctactgggtctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 46378 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacgcttcagttcactctcggctggcctttgtacttag

SEQ ID NO: 46379 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46380 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46381 - DNA, 447 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgcggccaggcccacggcttgaccccggagcaggtggtgcaattaatacgcgtaccgctagccaggaagagtttgtagaaacgcaaaaaggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46382 - DNA, 394 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaaagcattgctcatcaatttgttgcaacgaacaggtcactatccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46383 - DNA, 396 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtacgtggtggccatctccaccacctgctcctccgctggaccgtctccgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46384 - DNA, 401 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccatcgccagccacgatggcggcaaacagccgctggacaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46385 - DNA, 355 bp, Artificial
  Mutation in BnaA.FAD2.a introduced by TALE nuclease pair BnFAD2_T05
ccctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46386 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacaaccctttgggacgcaccgtgatgttaacggttcagttcactctcggctggcctttgtacttag

SEQ ID NO: 46387 - DNA, 359 bp, Artificial
  Mutation in BnaA.FAD2.a introduced by TALE nuclease pair BnFAD2_T05
cctctcctccctcaccctctctcctacttcgcctggcctctttactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 46388 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46389 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcatgtggtacggcaagtacctcaacaaccctttgggacgcaccgtgatgttaacggttcagttcactctcggctggcctttgtacttag

SEQ ID NO: 46390 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagccctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46391 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctccttgaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 46392 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46393 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggcttgacgacaccgtcggtctcatcttccactccttcctcctcgtcccttacttctcctggaagtacagtcatcgacgccaccattccaacactggctccctcgagacagacgaagtgtttgtccccaagaagaagtcagacatcaagtggtacggcaagtacctcaacaaccctgtgggacgcaccgtgatgttaacggttcagttcactctcggctggcctgtgtacttag

SEQ ID NO: 46394 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46395 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46396 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 46397 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46398 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaggtgtttgtccccaagaagaagtcagacatcaagtggtacggcaagtacctcaacaaccctttgggacgcaccgtgatgttaacggttcagttcactctcggctggcctttgtacttag

SEQ ID NO: 46399 - DNA, 359 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46400 - DNA, 329 bp, Artificial
  Mutation in BnaA.FAD2.a introduced by TALE nuclease pair BnFAD2_T05
cctatcctccctcaccctctcccttacctcgcctggcccctctactgggcctgccagggctgcgtcctaaccggcgtctgggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46401 - DNA, 364 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46402 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46403 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccatggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46404 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46405 - DNA, 358 bp, Artificial
  Mutation in BnaA.FAD2.a introduced by TALE nuclease pair BnFAD2_T05
cctctcctccctcaccctctctcctacttcgcctggcctctctactgggcctgtcagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagggacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 46406 - DNA, 362 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46407 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46408 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgccaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccccaacaacccgctaggacgcacggggaagctaaccgtccatctcacgcgcggctggcctttgtacttag

SEQ ID NO: 46409 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtccggcaagtacctcaacacccctttgggccgcaccgtgattttaacggttccgttcactctcggctggcctttgtccttag

SEQ ID NO: 46410 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccatgaagaagtcagacatcaagtggtacggcaagtacctcaacaaccctttgggacgcaccgtgatgttaacggttcagttcactctcggctggcctttgtacttag

SEQ ID NO: 46411 - DNA, 353 bp, Artificial
  Mutation in BnaA.FAD2.a introduced by TALE nuclease pair BnFAD2_T05
cctctcctccctcaccctctctcctacttctcctggcctctctactgggcctgccagtgctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46412 - DNA, 430 bp, Artificial
  Mutation in BnaA.FAD2.a introduced by TALE nuclease pair BnFAD2_T05
cctctcctccctctccctctctcctacttcgcctggcctctctactgggcctgccagggctgcgtcctaaccggcgtctgggtcatagcccacgagtgccaggcccacggcaacagccgctggaccgtctccagcgcctgcttgccaccattattgctggcgatggccacccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46413 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaatgcggcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46414 - DNA, 360 bp, Artificial
  Mutation in BnaA.FAD2.a introduced by TALE nuclease pair BnFAD2_T05
cctctcctccctcaccctctctcctacttcgcctggcatctctactgggcctgccaagggtgcgtcctaaccggcgtctgggtcatagcccacgagtgtgccaccacgccttcagcgactaccagtggctggacgacaccgtcggcctcatcttccactccttcatcctcgtcccttacttctcctggaagtacagtcagcgacgccaccattccaacactggctccctcgagagagacgaagtgtttgtccccaagaagaagtcagacatcaagtggtacggcaagtacctcaacacccctttgggacgcaccgtgatgttaatggttcagttcactctcggctggcctttgtacttag

SEQ ID NO: 46415 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggccatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46416 - DNA, 360 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46417 - DNA, 425 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaccgccattgctggcgatgagctttcaccgacaaacaacagataaaacgaaaggcccagtcttaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46418 - DNA, 347 bp, Artificial
  Mutation in BnaA.FAD2.a introduced by TALE nuclease pair BnFAD2_T05
cctctcctccctcaccctctctcctacttcgcctggcctctctaccgggcccgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46419 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46420 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46421 - DNA, 398 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggtaatacggttatccacagaatcaggggataacggccaccacgccttcagcgaccaccagtggctggacgccgccgtgggcctcgtcttccactccttcctcctcgtcccttacttctcccggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46422 - DNA, 430 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaggcccacggcaacagccgctggaccgtctccagcgcctgcttgccaccattattgctggcgatggccacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46423 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtgcctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46424 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 46425 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgatgatggaagtaccagtggctggacgacaccgtcgacctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggcttgcctttgtacttag

SEQ ID NO: 46426 - DNA, 463 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctgcgttaagccaacacccggcagcgttagggaccgtcgctgtcaagtatcaggacattttttctgcgcgtaatctgctgcttgcaaacaaaaaaaccaccgctggaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46427 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46428 - DNA, 360 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46429 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46430 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatcgcccccacaccttccgcgcctaccattggctggacgacgccgtcggcctcatcttccactccttcctcctcgtcccttacttctcctggaagtacagtcagcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46431 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacaacgccttcagcgactaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46432 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcaccgcccacgagtgtcaccacgccttcagcgactaccagcggctggacgacaccgtcggcctcatcttccactcctttctcctcgtcccttacttctcctggaagtacagtcatcgacgccaccattccaacactggctccctcgagagagacgaagtgtttgtccccaagaagaaatcagacatcaagtggtacggcaagtacctcaacaaccctttgagacgcaccgtgatgttaacggttcagttccctctcggctggccttagtacatag

SEQ ID NO: 46433 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcgagtggtacggcaagtacctcaacaaccctttgggacgcaccgtgatgttaacgtttcagttcacgctcggctggcctgagtacttag

SEQ ID NO: 46434 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46435 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46436 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcacacgccttcagcgactaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46437 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46438 - DNA, 323 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46439 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacatcaacaaccctttgggacgcaccgtgatgttaacggttcagttcactctcggctggcctttgtacttag

SEQ ID NO: 46440 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattcaaacaccggatccctcgatagggacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46441 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccggccaccacgccttcagcgactaccagtggctggacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggaaagtacctcaacaacccgctaggacgcacggtgatgctaaccgtccatttcacgctcggctggcctgtgtacttag

SEQ ID NO: 46442 - DNA, 371 bp, Artificial
  Mutation in BnaA.FAD2.a introduced by TALE nuclease pair BnFAD2_T05
cctctcctccctcaccctctctcctacttcgcctggcatctctactgggcctgccagggctgcgtcctaaccggcgtctgggtcatagcccacgcctgcttgccaccgccatcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46443 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtccttag

SEQ ID NO: 46444 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 46445 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46446 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtatgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46447 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttttacttag

SEQ ID NO: 46448 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 46449 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 46450 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacgtttcagttcactctcggctggcctgtgtacttag

SEQ ID NO: 46451 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggcttgacgacaccgtcggtctcatcttccactccttcctcctcgtcccttacttctcctggaagtacagtcatcgacgccaccattccagcactggctccctcgagagggacgaagtgtttgtccccaagaagaagtcagacatcaagtggtacggcaagtacatcaacaaccctttgggacgcaccgtgatgttaacggttcagttcactctcggctggcctttgtacttag

SEQ ID NO: 46452 - DNA, 346 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46453 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcggcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggaagcaccgtgatgttaacggttcagttcactctcggctggcctttgtacttag

SEQ ID NO: 46454 - DNA, 342 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactctcggctggcctttgtacttag

SEQ ID NO: 46455 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaccactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46456 - DNA, 403 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcaggcggtggccatcgccagcaataatggtggcaagcaggcgctggagaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggggatgctaaccgtccagttcacgctcggctgccctgtgtacttag

SEQ ID NO: 46457 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46458 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtccgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttggcacgcaccgtgatgttaacggttcagttcactctcggctggcctttgtacttag

SEQ ID NO: 46459 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46460 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgaccacgccttcagcgactaccagtggctggacgacaccgtcgtcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggccggcctttgtacttag

SEQ ID NO: 46461 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46462 - DNA, 392 bp, Artificial
  Mutation in BnaA.FAD2.a introduced by TALE nuclease pair BnFAD2_T05
cctctcctccctcaccctctcccttaccccgcctggcccccctactgggcctgccaaggccgcgtcctaacgggcctctgggtcatcgcccacgaacgaaacccgacaggactataaagataccaggcgtttccaccacgccttcagcgaccaccagtggctggacgacgccgtgggcctcgtcttccactccttcctcctcgtcccttacttcccctggaagtacagtcatcgacgccaccattccaacactggctccctcgagagagccgaagtgtttgtccccaagaagaagtcaaacatcaaatgatacggcaagtacctcaacaaccctttgggacgcaccgggatgttaacggttcagttcactctcggctggcctttgtacttag

SEQ ID NO: 46463 - DNA, 432 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggcgggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46464 - DNA, 358 bp, Artificial
  Mutation in BnaA.FAD2.a introduced by TALE nuclease pair BnFAD2_T05
cctctcctccctcaccctctcacctacttcgcctggcctctctactgggcctgccagggctgcgtcctcaacggcgtctgggtcatcgcccacgagtgccgccacgccttcagcgactaccactggctggacgacaccgtgggcctcgtcttccactccttcctcctcgtcccttacttctcctggaagtacagccatcgacgccaccattccaacaccggatccctcgagagggatgaagtgttcgtccccaagaagaagtccgacatcaagtggtacggcaagtaccgcaacaaccctgtgggacgcacggggatgttaacggttcagttcactctcggctggcctttgtacttag

SEQ ID NO: 46465 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctgcacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46466 - DNA, 361 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagacaggcagaaatgtcgtatgccgccttctgcttgaaaaaaacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccgtttgggacgcaccgtgatgttaacggttcagttcactctcggctgggctttgtactgag

SEQ ID NO: 46467 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaccgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttctctctcggctggcctttgtacttag

SEQ ID NO: 46468 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgggaggttaacggttcagttcactctcggctggcctttgtacttag

SEQ ID NO: 46469 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46470 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactcgctccctcgagagagacgaagtgtttgtccccaagaagaagtcagacatcaagtggtacggcaagtacctcaacaacccttggggacgcaccgtgatgttaacggttcagttcacgctcggctggccgtggtacttag

SEQ ID NO: 46471 - DNA, 364 bp, Artificial
  Mutation in BnaA.FAD2.a introduced by TALE nuclease pair BnFAD2_T05
cctctcctccctcaccctctctcctacttcttctgccctctctactgttcttcccatctctgcgccctcaccggcgtctgggtcatcgcccacgagcgcgtcctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtgcggcaagtacccgaacgcccctgtgggacgcaacgtgctgctaccggttcagttccctctcggctggcctttgtacttag

SEQ ID NO: 46472 - DNA, 383 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcggcctccagcggctgttgccggtgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46473 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagtgctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46474 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 46475 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46476 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacgtag

SEQ ID NO: 46477 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46478 - DNA, 319 bp, Artificial
  Mutation in BnaA.FAD2.a introduced by TALE nuclease pair BnFAD2_T05
cctctcctccctcaccctctctcctacttcgcctggcttctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctctgagacgcaccgtgatgtaaacggttcagtgcacgctcggctggcctttgtacttag

SEQ ID NO: 46479 - DNA, 364 bp, Artificial
  Mutation in BnaA.FAD2.a introduced by TALE nuclease pair BnFAD2_T05
cctctcctccctcaccctctgtcctacttcgcctggcctctctactgggcctgccagggctgcgtcctaaccggcgtctgggtcatagcccacgagtgcggccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcagcaaccctttggaacgcaccgtgatgttaacggttcagttcactctcggctggcctttgtacttag

SEQ ID NO: 46480 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttac

SEQ ID NO: 46481 - DNA, 444 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagatcaatgtcgatcgtggctggctcgaagatacctgcaagagtctcatattcactctcaatccaaataatctgcaccggatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 46482 - DNA, 432 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46483 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46484 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46485 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46486 - DNA, 424 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46487 - DNA, 392 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcttctagctgataaattcatgccggagagggtggccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46488 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccagcactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46489 - DNA, 363 bp, Artificial
  Mutation in BnaA.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgcggcgccaccacgccttcagccactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacgtttcagttcactctcggctggcctttgtacttag

SEQ ID NO: 46490 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgaccaccagtggctggacgacgccgtgggcctcgtcttccactccttcctcctcgtcccttacttctcctggaagtacagccatcgacgccaccattctaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46491 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46492 - DNA, 394 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcgatggccaccacctgctggggggtcaagccgtgggccttgaccccgtcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46493 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggctggacgacaccgtcggactcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46494 - DNA, 394 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgatggccaccacctgctggggggtcaagccgtgggccttgaccccgtcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46495 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46496 - DNA, 332 bp, Artificial
  Mutation in BnaA.FAD2.a introduced by TALE nuclease pair BnFAD2_T05
cctctcctccctcaccctctctcctacttcgcctgcctctctactaggcctgagcaggttattgctggggggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46497 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcaccacgccttcagcgactaccagtggcttgacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46498 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccacaagaagaaatccgacatcaagtggtacggcaagtacctcaacaaccctttgggacgcaccgtgatgttaacggttcagttcactctcggctggcctttgtacttag

SEQ ID NO: 46499 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46500 - DNA, 395 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggtggccatcgccagcaatggcggtggcaacagccgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 46501 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46502 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgaccaccagtggctggacgacgccgtgggcctcgtcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 46503 - DNA, 362 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46504 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46505 - DNA, 394 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgatggccaccacctgctggggggtcaagccgtgggccttgaccccgtcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46506 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacaggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46507 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgtgagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46508 - DNA, 448 bp, Artificial
  Mutation in BnaA.FAD2.a introduced by TALE nuclease pair BnFAD2_T05
cctctcctcctcaccctctctcctacttcgcctggcctctctactgggcctgccagggctgcgtcctaaccggcgtctgggtcatagcccacgagcggctgttgccggtgctgtgccaggcccacggcttgaccccccgctccggggtctggccatcgccagccacgatggcggcaacagccgctggacccaccacgccttcagcgactaccagtggctggacgaccccgtcggcctcatcttccactccttcctcctcgtcccttacttcgccgggaagtacagtcatcgacgccaccattccaacactggctccgtcgagagagacgaagtgttggtccccaagaagaagtcagacatcaagtggtacggcaagtacctcaacaaccctttgggacgcaccgtgatgttacggttcagttcactctcggctggcctttgtacttag

SEQ ID NO: 46509 - DNA, 355 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 46510 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46511 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagccctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46512 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46513 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46514 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcactgtgatgttaacggttcagttcactctcggctggcctttgtacttag

SEQ ID NO: 46515 - DNA, 392 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46516 - DNA, 333 bp, Artificial
  Mutation in BnaA.FAD2.a introduced by TALE nuclease pair BnFAD2_T05
cctctcctccctcaccctctatcctacttcgcctggcctctctactgggcctgccaaggctgcgtcctaacgggcctctgggtcatcgcccacgaatgtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46517 - DNA, 403 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcaggtggtggccatcgccagcaataatggtggcaagcaggcgctggagaaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46518 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccatgagtgcggccgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46519 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46520 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtttttgtccccaagaagaagtcagacatcaagtggtacggcaagtacctcaacaaccctttgggacgcaccgtgatgttaacggttcagttcactctcggctggcctttgtacttag

SEQ ID NO: 46521 - DNA, 359 bp, Artificial
  Mutation in BnaA.FAD2.a introduced by TALE nuclease pair BnFAD2_T05
cctctcctccctcaccctctctcctacttcgcctggcctatccactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 46522 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46523 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctcaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46524 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 46525 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctagcctttgtacttag

SEQ ID NO: 46526 - DNA, 361 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatcgcccacgagacaggcagaaatctcgtcagcggccatcagcgtctaaacaacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtgcctcaacaaccgtttgggacggaccgtgatgttaacggttcagttcactctcggctggcctttgtacttag

SEQ ID NO: 46527 - DNA, 358 bp, Artificial
  Mutation in BnaA.FAD2.a introduced by TALE nuclease pair BnFAD2_T05
cctctcctccctcaccctctcccttacctcgcctggcccctctactgggcctgctaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46528 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacactgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46529 - DNA, 357 bp, Artificial
  Mutation in BnaA.FAD2.a introduced by TALE nuclease pair BnFAD2_T05
cctatcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46530 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46531 - DNA, 359 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46532 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaaggagaagtcagacatcaagtggtacggcaagtacctcaacaaccctttgggacgcaccgtgatgttaacggttcagttcactctcggttggcctttgtacttag

SEQ ID NO: 46533 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46534 - DNA, 355 bp, Artificial
  Mutation in BnaA.FAD2.a introduced by TALE nuclease pair BnFAD2_T05
cctctcctccctcaccctctcccttacctcgcctggcccctctactgtgcctgccaaggctgcgtcctaacgggcctctgggtcatcgcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaactcagacatcaagtgctccggcatcgacctcaacaaccctttggtacgcaccgtgatgttaacggttcagttctctctcggctggcctttgtacttag

SEQ ID NO: 46535 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcatggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46536 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46537 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46538 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46539 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46540 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 46541 - DNA, 360 bp, Artificial
  Mutation in BnaA.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcgccaccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccttaacaaccctttgggacgcaccgggatgttaacggttcagttcactctcggctggcctttgtacttag

SEQ ID NO: 46542 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgccctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcgcggtgatgctaaccgtccagttcacgctcggctggcctttgtacttag

SEQ ID NO: 46543 - DNA, 462 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctgcgttaagccaacacccggcagcgttagggaccgtcgctgtcaagtatcaggacattttttctgcgcgtaatctgctgcttgcaaacaaaaaaaccaccgctggaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 46544 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46545 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagccctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 46546 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcgtctggctcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagacagacatcaagtggtacggcaagtacctcaacaaccctgtgggacgcgccgtgatgttaacggttcagttgactctcggctggccgttgtacttag

SEQ ID NO: 46547 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtatagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46548 - DNA, 471 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcttggcgatggcaagcaggcgctggagacggcccagcggctgttgccggcgctgtgcccggcccacggcttgacctcccagcaggcggtggccatccccagcaataatggcggcaagcaggcgccaccacgccttcagcgactaccagtggcttgacgacaccgtcggtctcatcttccactccttcctcctcgtccctttcttctcctggaaggacaagcatcgacgccaccattccaacactcgctccctcggaagagacgaagtgtttgtccccaagaaaaagtcagacatcaagtggttcggcaaggacctcaacaaccctgtgggacgcaccgtggtgttaacctttcagttccctctcggctggcctttgtacttag

SEQ ID NO: 46549 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46550 - DNA, 362 bp, Artificial
  Mutation in BnaA.FAD2.a introduced by TALE nuclease pair BnFAD2_T05
cctctcctccctcaccctctctcctacttcgcctggactctctactgggcctgacagggctgcgtcctaaccggcgtctgggtcatagcccacgagtgccggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46551 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaggagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46552 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgactaccagtggctggacgacaccgtcggcctcatcttccactccttcctcctagtcccttacttctcctggaagtacagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46553 - DNA, 444 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagatcaatgtcgatcgtggctggctcgaagatacctgcaagagtctcatattcactctcaatccaaataatctgcaccggatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcatttgtacttag

SEQ ID NO: 46554 - DNA, 402 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46555 - DNA, 358 bp, Artificial
  Mutation in BnaA.FAD2.a introduced by TALE nuclease pair BnFAD2_T05
cctctcctccctcaccctctctcctacttcgcctggactctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcacgctcggctggcctttgtacttag

SEQ ID NO: 46556 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46557 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46558 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcatgctcggctggcctttgtacttag

SEQ ID NO: 46559 - DNA, 354 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggctggacgacaccgtcggtctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46560 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccgccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46561 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46562 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46563 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagccctaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46564 - DNA, 356 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46565 - DNA, 347 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcatcgtgatgttaacggttcagttcactctcggctggcctttgtacttag

SEQ ID NO: 46566 - DNA, 362 bp, Artificial
  Mutation in BnaA.FAD2.a introduced by TALE nuclease pair BnFAD2_T05
cctctcctccctcaccctctcccttacctcgcctggactctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46567 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgctttcagcgactaccagtggcttgacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 46568 - DNA, 359 bp, Artificial
  Mutation in BnaA.FAD2.a introduced by TALE nuclease pair BnFAD2_T05
cctctcctccctcaccctctcacctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggtgcagttcactctcggctggcctttgtacttag

SEQ ID NO: 46569 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 46570 - DNA, 355 bp, Artificial
  Mutation in BnaA.FAD2.a introduced by TALE nuclease pair BnFAD2_T05
cctctcctccctcaccctctctcggctggcctctctactgggcctgccagggctgcgtcctaaccggcgtctgggtcatagcccacgagtgcgggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46571 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaaccggcctctgggtcatcgcccacgaacccccccgccttccgcgcctaccaggggctggacgacacggtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46572 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcaactaccagtggctggacgacaccgtctgcctcatcttccactccttcctcctcgtcccttacttctcctggaagtacagtcatcgacgccaccattccaacactggctccctcgagagagacgaagtgtttgtccccaataagaagtcagacatcaactggtacggcaggtacctcaacaacccttcgggacgcaccgtgatgttaaccgttcagttcacgctcggctggcctttgcacttag

SEQ ID NO: 46573 - DNA, 353 bp, Artificial
  Mutation in BnaA.FAD2.a introduced by TALE nuclease pair BnFAD2_T05
cctctcctcactcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46574 - DNA, 358 bp, Artificial
  Mutation in BnaA.FAD2.a introduced by TALE nuclease pair BnFAD2_T05
cctctcctccctcaccctctcccttacctcgcctggcccctctactgggcctgacaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46575 - DNA, 430 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaggcccacggcaacagccgctggaccgtctccagcgcctgcttgccaccattattgctggcgatggccacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46576 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 46577 - DNA, 395 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaacagccgctggaccacgcctgcagcgcctaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtccggcaagtacctcaacaaccctttgggacgcaccgtgatgttaacggttcagttcactctcggctggcctttgtacttag

SEQ ID NO: 46578 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcataaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46579 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46580 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 46581 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46582 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46583 - DNA, 350 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46584 - DNA, 356 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccgagaagaagtcaaacatcgagtggtacggcgagtacctcaacaaccctttggaacgcaccgtgatgttaacggttcagttcactctcggctggcctttgtacttag

SEQ ID NO: 46585 - DNA, 352 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatagcccacgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggtcgcaccgtgatgttaacggtgcagttcactctcgggtagccattgtacttag

SEQ ID NO: 46586 - DNA, 449 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgttcttcatgaaggtgtacggctacaggggcaagcacctgggcggctccaggaagcccgacggcgccatctacaccgtgggctcccccatccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46587 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 46588 - DNA, 447 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaggcccacggcttgaccccggagcaggtggtgcaattaatacgcgtaccgctagccaggaagagtttgtagaaacgcaaaaaggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46589 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtcgtacgtcaagtacctcaacaaccctttgggacgcaccgtgatgttaacggttcagttcactctcggctggcctttgtacttag

SEQ ID NO: 46590 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 46591 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccgtcagcgactaccagtggctggacgacgccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46592 - DNA, 362 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcaagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46593 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46594 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46595 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46596 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcatctaccaccagtggctggacgacgccgttggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgctgttaacggttcagttccctctcggctggcctttgtacttag

SEQ ID NO: 46597 - DNA, 419 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcggtacgcgtattaattgcgttgcgctcactgcccgcaaaaggccagcaaaaggccaccacgccttcagcgactaccagtggctggacgacaccgtcggcctcatcttccactccttcctcctcgtcccttacttctcctggaagtacaggcatcgacgccaccagtccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46598 - DNA, 361 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 46599 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46600 - DNA, 438 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccattgctggcgatggccaccacctgctccggggtcaagccgtgggcctggcacagcaccggcaacagccgctggagagaccacgccttcagcgactaccagtggctggacgacaccgtcggcctcatcttccactccttcctcctcgtcccttacttctcctggaattacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46601 - DNA, 394 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46602 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 46603 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctatgggacgcaccgtgatgttaacggttcagttcactctcggctggcctttgtacttag

SEQ ID NO: 46604 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46605 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46606 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46607 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46608 - DNA, 354 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46609 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagccctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcaggcatcaagtggtacggcaagtacctcaacaaccctttgggacgcaccgtgatgttaacggttcagttcactctcggctggcctttgtacttag

SEQ ID NO: 46610 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46611 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccacaagaagaagtcagacatcaagtggtacggcaagtacctcaacaaccctttgggacgcaccgtgatgttaacggtgcagttcactctcggctggactttgtacttag

SEQ ID NO: 46612 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46613 - DNA, 333 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46614 - DNA, 355 bp, Artificial
  Mutation in BnaA.FAD2.a introduced by TALE nuclease pair BnFAD2_T05
cctccctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtccctcaacaacccgctaggacgcacggtgatgctaaccgtccagttcacgctcggctggcctttgtacttag

SEQ ID NO: 46615 - DNA, 345 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46616 - DNA, 398 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcgggtttcggcaggtggtggccatcgccagcaatggcggtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46617 - DNA, 424 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46618 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctgggagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46619 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccgcgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46620 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatggtaacggttcagttcactctcggctggcctttgtacttag

SEQ ID NO: 46621 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcattctcggctggcctttgtacttag

SEQ ID NO: 46622 - DNA, 402 bp, Artificial
  Mutation in BnaA.FAD2.a introduced by TALE nuclease pair BnFAD2_T05
cctctcctacctcaccctctcccttacctcgcctggcctctctactgggcctgccagggctgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46623 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaaaaccacgccttcagcgactaccagtggctggacgacgccgtgggcctcatcttccactccttcctcctcgtcccttacttctcctggaagtacagtcatcgacgacaccattccaacactggctccctcgagagagacgaagtgtttgtccccaagaagaagtcagacatcaagtggtacggcaagtacctcaacaaccctttgggacgcaccgtgatgtttacggttcagttcactctcggctggcctttgtacttag

SEQ ID NO: 46624 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggctagtacctcaacaaccctttgggacgcaccgtgatgttaacggttcagttcactctcggctggcctttgtacttag

SEQ ID NO: 46625 - DNA, 282 bp, Artificial
  Mutation in BnaA.FAD2.a introduced by TALE nuclease pair BnFAD2_T05
cctctcctccctcaccctctcccttaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacctttgggacgcaccgtgatgttaacggttcagttcactctcggctggcctttgtacttag

SEQ ID NO: 46626 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaacgggcctctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46627 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46628 - DNA, 333 bp, Artificial
  Mutation in BnaA.FAD2.a introduced by TALE nuclease pair BnFAD2_T05
cctctcctccctcaccctctctcctacttcgcctggcctctctactgggcctgagcaggttattgctggggggtcaccacgccttcagcgactaccagtggctggacgacaccgtctgcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46629 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46630 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgcaccacgccttcagcgaccaccattggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46631 - DNA, 358 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46632 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacaacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46633 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggtcgcaccgtgatgttaagaggtgagttcactctcggctggcatttgtacttag

SEQ ID NO: 46634 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggcttcagcgactaccaggggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgctcagttcactctcggctggcctttgtacttag

SEQ ID NO: 46635 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaaaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtcaccaagaagaaatccgacatcaagtggtacggaaagtacctcaacaacccgctaggacgcacggtgatgctaaccgtccagttcacgctcggctggcctttgtacttag

SEQ ID NO: 46636 - DNA, 355 bp, Artificial
  Mutation in BnaA.FAD2.a introduced by TALE nuclease pair BnFAD2_T05
cctctcctccctcaccctctctcctacttcgcccggcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 46637 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46638 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 46639 - DNA, 394 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcgatggccaccacctgctggggggtcaagccgtgggccttgaccccgtcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46640 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46641 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46642 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaataagtcagacatcaagtggtacggcaagtacctcaacaaccctttgggacgcaccgtgatgttaacggttcagttcactctcggctggcctttgtacttag

SEQ ID NO: 46643 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46644 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactagctccctcgagagagacgaagtgtttgtccccaagaagaagtcagacatcaagtggtacggcaagtacctcaacaaccctttgggacgcaccgtgatgttaacggttcggtgcactctcggctggcctttgtacttag

SEQ ID NO: 46645 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46646 - DNA, 361 bp, Artificial
  Mutation in BnaA.FAD2.a introduced by TALE nuclease pair BnFAD2_T05
cctctcctccctcaccctctctcctacttcgcctggcctctctactggtcctgccagggctgcgtctaacccgccttttgggtattgccccccagtggcgccacctacgcctccaccaactaccagtggcttgacgacactttcggtctcatcttccactccttcctcctcgtcccttacttctcctggaagtacagccatcgacgccaccattccaacactggctacatcgagagagacgaagtgtttgtccccaagaagaagtcagacaacaagtggtacggcaagtacctcaacaaccctttgggacgcaccgggatgttaacggttcagttcactctcggctggcctttgtacttag

SEQ ID NO: 46647 - DNA, 359 bp, Artificial
  Mutation in BnaA.FAD2.a introduced by TALE nuclease pair BnFAD2_T05
cctctcctccctcaccctatctcctacttcgcctggcctctctactgggcctgccagggctgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46648 - DNA, 333 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 46649 - DNA, 319 bp, Artificial
  Mutation in BnaA.FAD2.a introduced by TALE nuclease pair BnFAD2_T05
cctctcctccctcaccctttctcctacttcgcctggcctctctactgtgcctgccagggctgcgccctaaccggcgtctgggtcatagcccacgagtgcgtcggcatcatcttccactccttcctcctcgtcccttacttctcctggaagtacagtcatcgacgccaccattccaacactggctccctcgagagagacgaagtgtttgtccccaagaagaagtcagacatcaagtggtacggcaagtacgtcaacagcccttgaggagtctccgtgatggcaacggttcccttcaccctcggctggcctttgtacttag

SEQ ID NO: 46650 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgccggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 46651 - DNA, 353 bp, Artificial
  Mutation in BnaA.FAD2.a introduced by TALE nuclease pair BnFAD2_T05
cctctcctccctcaccctctctcctacttcgcctggcctctctactgggcctgacaagggtgcgtcctaaacggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggctattatctcaaccaccgtttggtacgcaccgtggtgttaacgtttcagttcactctcggctggcctttgtacttag

SEQ ID NO: 46652 - DNA, 462 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgactcaagcgcctgcttgccgccatcgtggctccgccaccctccgggccgttgcttcacaacgttcaaatccgctcccggcggatttgtcctactcaggagagcgtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46653 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46654 - DNA, 358 bp, Artificial
  Mutation in BnaA.FAD2.a introduced by TALE nuclease pair BnFAD2_T05
cctctcctccctcacactctcccttacctcgcctggcccctctactgggcctgccaaggctgcgtcctaacgggcctctgggtcatcgccctcgaatgcgaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46655 - DNA, 360 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtgcggccacacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 46656 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46657 - DNA, 419 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcggtacgcgtattaattgcgttgcgctcactgcccgcaaaaggccagcaaaaggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcggttcactctcggctggcctttgtacttag

SEQ ID NO: 46658 - DNA, 352 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46659 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46660 - DNA, 362 bp, Artificial
  Mutation in BnaA.FAD2.a introduced by TALE nuclease pair BnFAD2_T05
cctctcctccctcaccctgtctcctacttcgcctggcctctctactgggcctgccagggctgcgtcctaaccgccgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctgtgggatgcaccgtgatgttaacggttcagttcactctcggctggcctttgtacttag

SEQ ID NO: 46661 - DNA, 344 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46662 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46663 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacaggcgtctgggtcatagcccaccacgccttcagcgactaccagtggctcgacgacaccgtcggcctcatcttccactccttcctcctcgtcccttacttctcctggaagtacagtcatcgacgccaccattccaacactggctccctcgagagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46664 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46665 - DNA, 333 bp, Artificial
  Mutation in BnaA.FAD2.a introduced by TALE nuclease pair BnFAD2_T05
cctctcctccctcaccctctctcctacttcgcctggcctctctactaggcctgagcaggttattgctggggggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 46666 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46667 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46668 - DNA, 471 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcttggcgatggcaagcaggcgctggagacggtccagcggctgttgccggtgctgtgccaggcccacggcttgaccccccagcaggtggtggccatcgccagcaataatggtggcaagcaggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46669 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46670 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46671 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagccatcgacgccaccattccaacaccggatccctcgatagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 46672 - DNA, 346 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaaggttcagttcactctcggctggcctttgtacttag

SEQ ID NO: 46673 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46674 - DNA, 401 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagccatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46675 - DNA, 333 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46676 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcggacatcaagtggtacggcaagtacctcaacaaccctttgggacgcaccgtgatgttaacggttcagttcactctcggctggcctttgtacttag

SEQ ID NO: 46677 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46678 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46679 - DNA, 356 bp, Artificial
  Mutation in BnaA.FAD2.a introduced by TALE nuclease pair BnFAD2_T05
cctctcctccctcaccctctcttctacttcgcctggcctctctactgggcctgccaagggtgcgtcctaaccggcgtctgggtcgtagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46680 - DNA, 419 bp, Artificial
  Mutation in BnaA.FAD2.a introduced by TALE nuclease pair BnFAD2_T05
cctctcctccctcaccatctccattacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 46681 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagtgctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46682 - DNA, 343 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaccagtggctggacgacgccgtgggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggcttgcctttgtacttag

SEQ ID NO: 46683 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46684 - DNA, 350 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46685 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46686 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagtgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46687 - DNA, 358 bp, Artificial
  Mutation in BnaA.FAD2.a introduced by TALE nuclease pair BnFAD2_T05
cctctcctccctcaccctctcccttacttcgcctggcctctctactgggcctgccagggctgcgtcctaaccggcgtctgggtcatagcccacgagtgccaccacgccttcagcgcctaccagtggctggacgacaccgtgggcctcgtcttccactccttcctcctcgtcccttacttctcatggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46688 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46689 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46690 - DNA, 447 bp, Artificial
  Mutation in BnaA.FAD2.a introduced by TALE nuclease pair BnFAD2_T05
cctctcctccctcaccctctccattacctcgcctggcccctctactgggcctgccaaggctgcgtcctaacgggcctctgggtcatcgcccacgaatgctgcttgccaccattattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46691 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 46692 - DNA, 447 bp, Artificial
  Mutation in BnaA.FAD2.a introduced by TALE nuclease pair BnFAD2_T05
cctctcctccctcaccctctcccttacctcgcctggcccctctactcggcctgacaaggctgcgtcctaacgagcctctgggtcatcgcccacgaatgctgcttgccaccgccattgctggcgatggccaccacctgctggggggtcaagccgtgggcctggcacagcaccggcaacagccgctggaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcagcaacccttggggacgcaccgtgatgttaacggttcagttcactctcggctggcctttgtacttag

SEQ ID NO: 46693 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46694 - DNA, 358 bp, Artificial
  Mutation in BnaA.FAD2.a introduced by TALE nuclease pair BnFAD2_T05
cctctccttcctcaccctctctcctacttcgcctggcctctctactgggcctgccagggctgcgtcctaaccggcgtctgggtcatagcccacgagtgcaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaattacctcaacaaccctttgggacgcaccgtgaggttaacggttcagttcacgctctgctggcctttgtacttag

SEQ ID NO: 46695 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcccttgtacttag

SEQ ID NO: 46696 - DNA, 355 bp, Artificial
  Mutation in BnaA.FAD2.a introduced by TALE nuclease pair BnFAD2_T05
cctctcctccctcaccctctctcctacttcgcctggcctctctactgggcatgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46697 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtacagttcacgctcggctggcctttgtacttag

SEQ ID NO: 46698 - DNA, 361 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 46699 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgaccaccagtggctgtacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46700 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 46701 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgactccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46702 - DNA, 358 bp, Artificial
  Mutation in BnaA.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46703 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46704 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcactctcggctggcctttgtacttag

SEQ ID NO: 46705 - DNA, 344 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 46706 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagtccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46707 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 46708 - DNA, 430 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtgccaggcccacggcaacagccgctggaccgtctccagcgcctgcttgccaccattattgctggcgatggccacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttac

SEQ ID NO: 46709 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46710 - DNA, 345 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46711 - DNA, 354 bp, Artificial
  Mutation in BnaA.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46712 - DNA, 360 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcggtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46713 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46714 - DNA, 356 bp, Artificial
  Mutation in BnaA.FAD2.a introduced by TALE nuclease pair BnFAD2_T05
cctctcctccctcaccctctcttctacttcgcctggcctctctactgggcctgccaagggtgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46715 - DNA, 362 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46716 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 46717 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46718 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46719 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtcccaaagaagaagtcagacatcaagtggtacggcaagtacctcaacagccctttgggacgcaccgtgatgttaacggttcagttcgctctcggctggcctttgtacttag

SEQ ID NO: 46720 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46721 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46722 - DNA, 401 bp, Artificial
  Mutation in BnaA.FAD2.a introduced by TALE nuclease pair BnFAD2_T05
cctctcctccctcaccctctcccttacctcgcctggccacactactgggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46723 - DNA, 348 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46724 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 46725 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46726 - DNA, 354 bp, Artificial
  Mutation in BnaA.FAD2.a introduced by TALE nuclease pair BnFAD2_T05
ctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttg

SEQ ID NO: 46727 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctgtgggccgcaccgtgaggttaacggttcagttcactctcggctggcctttgtacgtag

SEQ ID NO: 46728 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46729 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggccataccccacgagtgaccacgccttcagcgactaccattggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46730 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46731 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46732 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46733 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46734 - DNA, 356 bp, Artificial
  Mutation in BnaA.FAD2.a introduced by TALE nuclease pair BnFAD2_T05
cctctcctccctcaccctctctcctacttcgcctggcctatctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46735 - DNA, 356 bp, Artificial
  Mutation in BnaA.FAD2.a introduced by TALE nuclease pair BnFAD2_T05
cctctcctccctcaccctctctcctacttcgcctggcccctctactcggcctgccagggccgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcagcaaccctttgggacgcaccgtgaggttaacggttcagttcactctcggctggcctttgtacttag

SEQ ID NO: 46736 - DNA, 429 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggccatcgccagcaataatggtggcaagcaggcgctggagacggtccagcggctgttgacggtgctgtgccaggcccacggcttgacccccaccacgccttcagcgactaccagtggctggaccacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 46737 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46738 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46739 - DNA, 358 bp, Artificial
  Mutation in BnaA.FAD2.a introduced by TALE nuclease pair BnFAD2_T05
cctctcctccctcaccctctcccttacctcgcctggacacactactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgaggttaacggttcagttcactctcggctggccttggtacttag

SEQ ID NO: 46740 - DNA, 280 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46741 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagctaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcacacatcgagtggtacggcaagtacctcaacaaccctttgggacgcaccgtgatgtaaacggttcggttcacgctcggatggcctttgtgcttag

SEQ ID NO: 46742 - DNA, 356 bp, Artificial
  Mutation in BnaA.FAD2.a introduced by TALE nuclease pair BnFAD2_T05
cctctcctccctcaccctctctactacttcgcctggcatctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacattcatcgacgccaccattccaacactggctccctcgagagagacgaagtgtttgtccccaagaagaagtcagacatcaagtggtacggcaggtacctcaacatccctttgggacgcaccgtgatgttaacggttcggttcacgctcggctggcctttgtacttag

SEQ ID NO: 46743 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46744 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaaccctttggggcgcaccgtgatgttaacggttcagttcactctcggctggccgttgtacttag

SEQ ID NO: 46745 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46746 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcatccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46747 - DNA, 449 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgttcttcatgaaggtgtacggctacaggggcaagcacctgggcggccccaggaagcccgacggcgccatctacaccgtgggctcccccatccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaagacgcacggtgatgctaaccgtacagttgacgctcggctggcctttgtacttag

SEQ ID NO: 46748 - DNA, 424 bp, Artificial
  Mutation in BnaA.FAD2.a introduced by TALE nuclease pair BnFAD2_T05
ctctcctccctcaccctctctcctacttcgcctggcctctctactgggcctgccagggctgcgtcctaaccggcgtctgggtcatagcccacgagtgcggccaccgccattgctggcgatgagcgttcaccgacaaacaacagataaaacgaaaggcccagtcttaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46749 - DNA, 419 bp, Artificial
  Mutation in BnaA.FAD2.a introduced by TALE nuclease pair BnFAD2_T05
cctctcctccctcaccctctctcctacttcgtctggcctctctactcggcctgccagggctgcgtcctaaccgccgtctgggtcatagcccacgagtgcggccagcggtacgcgtattaattgcgttgcgctcactgcccgcaaaaggccagcaaaaggccaccacgccttcagcgactaccagtggctggacgacaccgtcgccctcatcttccactccttcctcctcgtcccttacttctcctggaagtacagtcatcgacgccaccattccaacactggctccctcgagagagacgaagtttttgtccccaagaagaagtcagacatcaagtggtacggcaagtacctcaacaaccctttgggacgcacgggaatgttaacggttcagttcactctcggctggcctttgtacttag

SEQ ID NO: 46750 - DNA, 419 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggtatcttcgagccagccacgatcgacattgatctggcacagcaccggatggtttgacgacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggccggcctttgtacttag

SEQ ID NO: 46751 - DNA, 333 bp, Artificial
  Mutation in BnaA.FAD2.a introduced by TALE nuclease pair BnFAD2_T05
cctctcctccctcaccctctctcctacttcgcctggcctctctactgggcctgagcaggttattgctggggggtcaccacgccttcagcgaccaccagtggctggacgacaccgtctgcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46752 - DNA, 445 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcttgaaggagccactcagccgcgggtttctggagtttaatgagctaagcacatacgtcagaaaccattattgcgcgttcaaaagtcgccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46753 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgctttcagcgactaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46754 - DNA, 396 bp, Artificial
  Mutation in BnaA.FAD2.a introduced by TALE nuclease pair BnFAD2_T05
cctctcctccctcaccctctctcctacttcgcctggcctctctactgggccatagccagcaataatggtggcaagcaggcgctggagacggtccagcggctgttgccggtgctgtgccaggcccaaggcttgacccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46755 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46756 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacatccctttgggacgcaccgtgatgttaacggttcagttcactctcggctggcctttgtacttag

SEQ ID NO: 46757 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcctcccttacttctcctggaagtacagtcatcgacgccaccattccaacactggctccctcgagagagacgaagtgtttgtccccaagaagaagtcagacatcaagtggtacggcaagtacctcaacatccctttgggacgcaccgtgattttaacggttcagttcactctcggctggcctttgtgcttag

SEQ ID NO: 46758 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 46759 - DNA, 329 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcccccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46760 - DNA, 349 bp, Artificial
  Mutation in BnaA.FAD2.a introduced by TALE nuclease pair BnFAD2_T05
cctctcctccctcaccctctcggctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 46761 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46762 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtggacctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46763 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccccgccaccacgccttcagcgactaccagtggctggacgacaccgtcggcctcatcttctactccttcctcctcgtcccttacttctcctggaagtacagtcatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46764 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatagtccacgagtgcggccgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46765 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccccccaccaccctttcagcgactaccagtggcttgacgacaccgtcggcctcatcttccactccttcctcctcgtcccttacttctcctggaagtacagtcatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46766 - DNA, 358 bp, Artificial
  Mutation in BnaA.FAD2.a introduced by TALE nuclease pair BnFAD2_T05
cctctcctccctcaccctctcccttacctcgcctgccccctctactgggcctgccaaggctgcgtcctaacgggcctctgggtcctcgcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgtaccgtgatgttaacggttcagttcactctcggctggcctttgtacttag

SEQ ID NO: 46767 - DNA, 349 bp, Artificial
  Mutation in BnaA.FAD2.a introduced by TALE nuclease pair BnFAD2_T05
cctctcctcctcaccctctctcctactttgcctggcctctctcctgggcctgccagggctgcgtcctacccggcgtctgggtcatagcccacgagtgccgccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaaggagtcagacatcaagtggtacggcaagtacctcaacaacccttcgggacgcaccgtgatgttaacggttaagtgcacgctcggctggcctttgtgcttag

SEQ ID NO: 46768 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgccctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccacaagaagaagtcagacatcaagcggtacggcccgtacctccacaaccgtcaggggcgtacaggaatgttaccggctccgttcactctcggctggcctttgtacttag

SEQ ID NO: 46769 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagttcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 46770 - DNA, 348 bp, Artificial
  Mutation in BnaA.FAD2.a introduced by TALE nuclease pair BnFAD2_T05
cctctcctccctcaccctctaccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46771 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggttcggcaagtacctcaacaacccttttggacgcaccgtgatgttaacggttcagttcactctcggctggcctttgtacttag

SEQ ID NO: 46772 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 46773 - DNA, 419 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46774 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaaggttaagttcactctcggctggactttgtacttag

SEQ ID NO: 46775 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccactagtgccaccacgccttcagcgactaccagtggctgtacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaacctgtgggacgcaccgtgatgttaacggttcatgtcattctcgggtggcatgtgtacttag

SEQ ID NO: 46776 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagccaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46777 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtcctcaagaagaaatccgacatcaagtggtacggaaagtacctcaacaacccgctaggacgcacggtgatgctaaccgtccagttcacgctcggctggcctttgtacttag

SEQ ID NO: 46778 - DNA, 332 bp, Artificial
  Mutation in BnaA.FAD2.a introduced by TALE nuclease pair BnFAD2_T05
ctctcctccctcaccctctctcctacttcgcctggcctctctactgggcctgccaaggctgcgtcctaacgggcctctgggtcatcgcccacgaatgtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46779 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcagctggcctttgtacttag

SEQ ID NO: 46780 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46781 - DNA, 396 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggtggccatcgccagcaatggcggtggcaagcaggcgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46782 - DNA, 362 bp, Artificial
  Mutation in BnaA.FAD2.a introduced by TALE nuclease pair BnFAD2_T05
cctcttctccctcaccctctctcctacttcgcctggcctctctactgggcctgccagggctgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46783 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 46784 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 46785 - DNA, 349 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcatagcccacgagtgatgatggaagtaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctatccgtccagttcacgctcggctggcctttgtacttag

SEQ ID NO: 46786 - DNA, 439 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccattgctggcgatggccaccacctgctccggggtcaagccgtgggcctggcacagcaccggcaagcaggcgctggagagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46787 - DNA, 358 bp, Artificial
  Mutation in BnaA.FAD2.a introduced by TALE nuclease pair BnFAD2_T05
cctcttctccctcaccctctctcctacttcgcctggcccctctactgggcctgccagggctgcgtcctaaccggcgtctgggtcatagcccacgagtgccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46788 - DNA, 359 bp, Artificial
  Mutation in BnaA.FAD2.a introduced by TALE nuclease pair BnFAD2_T05
cctcttctccctcaccctctctcctacttcgcctggcctctctactgggcctgccaagggtgcgtcctaaccggcgtctaggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccaggtcacgctcggctggcctttgtacttag

SEQ ID NO: 46789 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacaggtatgtttacggttcagttcactctcggctgggctttgtacttag

SEQ ID NO: 46790 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 46791 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacaacaccgtcggcctcatcttccactccttcctcctcctcccttacttctcctggaagtacagtcatcgacgccaccattccaacactggctccctcgagagagacgaagtgtttgtccccaagaagaagtcagacatcaagtggtacggcaagtacctcaacaacccttcgggacgcaccgtgatgttaacggttcagttcaccctcggctggcctcagtacttag

SEQ ID NO: 46792 - DNA, 419 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46793 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46794 - DNA, 394 bp, Artificial
  Mutation in BnaA.FAD2.a introduced by TALE nuclease pair BnFAD2_T05
cctctcctccctcaccctctcacttacctcgcctggcccctctactgggcctgccaaggctgcgtcctaacgggcctctgggtcatcgcccacgaatgcgacaaacaacagataaaacgaaaggcccagtcttcccaccacgccttcagcgaccaccagtggctggatgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46795 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 46796 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46797 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46798 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtacactctcggctggcctttgtacttag

SEQ ID NO: 46799 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46800 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccattggcttgacgaccccgtctgtctcatcttccactccttcctcctcgtcccttacttctccgggaagtacagtcatcgacgccaccattccaacactggctccctcgagagagacgaagtgtttgtccccaagaagaagtcagacatcaagtggtacggcaagtccctcaacagccctttgggacgcaccgtgatgttaacggttcagttcgctctgttctggcctttgtacttag

SEQ ID NO: 46801 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 46802 - DNA, 355 bp, Artificial
  Mutation in BnaA.FAD2.a introduced by TALE nuclease pair BnFAD2_T05
cctctcctccctcaccctctctcctacttcgcctggcctctctactggtcctgccagggctgcgccctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtccggcaagtacctcaacacccctgtgggacgcaccgtgatgttaacggttcatttcactctcggctggcctttgtacttag

SEQ ID NO: 46803 - DNA, 419 bp, Artificial
  Mutation in BnaA.FAD2.a introduced by TALE nuclease pair BnFAD2_T05
cctcttctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46804 - DNA, 430 bp, Artificial
  Mutation in BnaA.FAD2.a introduced by TALE nuclease pair BnFAD2_T05
cctcttctccctcaccctctctcctacttcgcctggcctctctactgggcctgccagggctgcgtcctaaccggcgtctgggtcatagcccacgagtgccaggcccacggcaacagccgctggaccgtctccagcgcctgcttgccaccattattgctggcgatggccacccaccacgccttcagcgactaccagtggctggacgacaccgtcggcctcatcttccactccttcctcctcgtcccttacttctccgggaagtacagacagcgacgccagcattccaacactggctccctcgagagagacgaagtgtttgtccccaagaagaagtcagacatcaagtggtacggcaagtacctcaacaaccctttgggacgcaccgtgatgttaacggttcagttcgctctcggttggcctttgtacttag

SEQ ID NO: 46805 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46806 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 46807 - DNA, 443 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46808 - DNA, 359 bp, Artificial
  Mutation in BnaA.FAD2.a introduced by TALE nuclease pair BnFAD2_T05
cctctcctccctcaccctctctcctacttcgcctggcctctcttctgggcctgccagggctgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46809 - DNA, 425 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaccgccattgctggcgatgagcgttcaccgacaaacaacagataaaacgaaaggctcagtcttaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46810 - DNA, 358 bp, Artificial
  Mutation in BnaA.FAD2.a introduced by TALE nuclease pair BnFAD2_T05
cctctcctccctcaccctctctcctacttcgcctcgcctctctactgggcctgccagggctgcatcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46811 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 46812 - DNA, 424 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtcttggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaacccttcgggacgcaccgtgatgttaacggttcagttcactctcggctggcctttgtacttag

SEQ ID NO: 46813 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46814 - DNA, 345 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcctctgggtcatcaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgggatgttaacggttcaggtctctcttggttggcctttttacttag

SEQ ID NO: 46815 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgttcagcgactaccagtggcttgacgacaccgtcggtctcatcttccactccttcctcctcgtcccttacttctcctggaattacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggccttagtacttag

SEQ ID NO: 46816 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgccaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46817 - DNA, 353 bp, Artificial
  Mutation in BnaA.FAD2.a introduced by TALE nuclease pair BnFAD2_T05
cctctcctccctcaccctctcccctacttcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagccatcgacgccaccattccaacaccggatccctcgagagggatgaagtgttagtccccaagaagaaatccgacatcaagtggtacggcaagtacctcaacaaccctttgggacgcaccgtgatgttaacggttcagttcactctcggctggcctttgtacttag

SEQ ID NO: 46818 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccgccgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgcgaaccgtccagttcacgctcggctggcctttgtactta

SEQ ID NO: 46819 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgcggcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46820 - DNA, 355 bp, Artificial
  Mutation in BnaA.FAD2.a introduced by TALE nuclease pair BnFAD2_T05
cctctcctccctcaccctctctcctacttctcctggcctctctactgggcctgccagggctgcgtcctaaccggcgtctgggtcatagcccacgaaaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46821 - DNA, 425 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaccgccattgctggcgatgagcgttcaccgacaaacaacagataaaacgaaaggctcagtcttaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46822 - DNA, 356 bp, Artificial
  Mutation in BnaA.FAD2.a introduced by TALE nuclease pair BnFAD2_T05
cctcttctccctcaccctctctcctacttcgcctggcctctctactgggcctgccagggctgcgtcctaaccggcgtctgggtcatagcccacgagccaccacgccttcagcgactaccagtggctggacgccaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46823 - DNA, 283 bp, Artificial
  Mutation in BnaA.FAD2.a introduced by TALE nuclease pair BnFAD2_T05
cctctcctccctcaccctctcccttaccgcgccttcagcgaccaccagtggctgaacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtttcctctcggctggcctttgtacttag

SEQ ID NO: 46824 - DNA, 353 bp, Artificial
  Mutation in BnaA.FAD2.a introduced by TALE nuclease pair BnFAD2_T05
cctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46825 - DNA, 356 bp, Artificial
  Mutation in BnaA.FAD2.a introduced by TALE nuclease pair BnFAD2_T05
cctctcctccctcaccctctctcctacttcgcctggcctctctactggacctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46826 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46827 - DNA, 371 bp, Artificial
  Mutation in BnaA.FAD2.a introduced by TALE nuclease pair BnFAD2_T05
cctctcctccctcaccctctctcctacttcgcctggcctccctactgggcctgccagggcagcgtcctaaccggcgactgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtggtgttaacggttcagtccactctcggctggcctttgtacttag

SEQ ID NO: 46828 - DNA, 357 bp, Artificial
  Mutation in BnaA.FAD2.a introduced by TALE nuclease pair BnFAD2_T05
cctctcctccctcaccctctctactacttcgcctcgcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctgcaagtacaatcatcgacgccaccattccaacactggctccctcgagagagacgaagtgtttgtccccaagaagaagtcagacatcaagtggtacggcaagtagctcaacaaccctttgggaggcaccgtgaggttaacggttcagttcaggctcggctggccttagtacttag

SEQ ID NO: 46829 - DNA, 401 bp, Artificial
  Mutation in BnaA.FAD2.a introduced by TALE nuclease pair BnFAD2_T05
cctctcctccctcaccctctcccttacctcgcctggcccctctactgggcctgccaaggatgcgtcctaacgggcctctgggtcatcgcccacgaatgcggctgttgccggtgctgtgtcaggcccacggcttgaccccggacaccacgccttcagcgaccaccagtggctggacgacgccgtgggcctcgtcttccactccttcctcctcgtcccttacttctcctggaagtacagtcatcgacgccaccattccaacactggctccctcgagagacacgaagtgtttgtccccaataagaagtcagacatcaagtggtacggcaagtacctcaacaacccttttggacgcaccgtgatgttaacggttcaggtccctctcggctggccttagtacttag

SEQ ID NO: 46830 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 46831 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46832 - DNA, 345 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46833 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46834 - DNA, 333 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgggggacgcaccgtgaggttaacggttcagttcacgctcggctggcctttgtacttag

SEQ ID NO: 46835 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46836 - DNA, 355 bp, Artificial
  Mutation in BnaA.FAD2.a introduced by TALE nuclease pair BnFAD2_T05
cctctcctccctcaccctatctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46837 - DNA, 403 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtcgggtttcgccacctctggtggtggccatcgccagcaatggcggtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46838 - DNA, 358 bp, Artificial
  Mutation in BnaA.FAD2.a introduced by TALE nuclease pair BnFAD2_T05
cctctcctccctcaccctctctcctacttcgcctagcctctctactccgcctgccagggccgcgtcctaaccggcggctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctgaacaactcattgggacgcacggtgatgtcaacggttcatttcactctcggctggcctttgtacttag

SEQ ID NO: 46839 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggatgcaccgtgatgttaacggttcagttcactctcggctggcctttgtacttag

SEQ ID NO: 46840 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 46841 - DNA, 445 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcttgaaggagccactcagccgcgggtttctggagtttaatgagctaagcacatacgtcagaaaccattattgcgcgttcaaaagtcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46842 - DNA, 443 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcctcaagccgtgggcctggtccagcggctgttgccaccgccattgctggcgatgtccaccacctgctggggggtcaagccgtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 46843 - DNA, 355 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46844 - DNA, 463 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctgcgttaagccaacacccggcagcgttagggaccgtcgctgtcaagtatcaggacattttttctgcgcgtaatctgctgcttgcaaacaaaaaaaccaccgctggaaccacgccttcagcgactaccagtggctggacgacaccgtcggcctcatcttccactccttcctcctagtcccttacttctcctggaagtacagtcatcgacgccaccattccaacactggctccctcgagagagacgaagtgtttgtccacaagaagaagtcagacatcaagtggtacggcaagtacctcaacaaccctttgggacgcaccgtgatgttaacggttcagttcactctcggctggcctttgtacttag

SEQ ID NO: 46845 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatggtaaccgttcagttcacgctcggctggcctttgtacttag

SEQ ID NO: 46846 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccttggtacttag

SEQ ID NO: 46847 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 46848 - DNA, 359 bp, Artificial
  Mutation in BnaA.FAD2.a introduced by TALE nuclease pair BnFAD2_T05
cctctcctccctcaccctctctcctacttcgcctggcctatctccttggcctgccagggctgcgtcctaaccggcgtctgggtcatagcccacgagtgcggaccacgccttcagcgactaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacccaccgggatgttaacggtgcaggtcacacgccgctggccttagtacttag

SEQ ID NO: 46849 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46850 - DNA, 360 bp, Artificial
  Mutation in BnaA.FAD2.a introduced by TALE nuclease pair BnFAD2_T05
cctctcctccctcaccctcgcccttacctcgcctggcccctctactgggcctgccaaggctgcgtcctaacgggcctctgggtcatcgcccacgaatgcggcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 46851 - DNA, 352 bp, Artificial
  Mutation in BnaA.FAD2.a introduced by TALE nuclease pair BnFAD2_T05
cctctcctccctcaccctctatactacttcgcctggcctctctactgggcctgccaagggtgcgtcctaaccggcgtctgggtcatagcccaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacacccctttgggacgcaccgtgatgttaacggttcagttcactctcggctggcagttggacttag

SEQ ID NO: 46852 - DNA, 355 bp, Artificial
  Mutation in BnaA.FAD2.a introduced by TALE nuclease pair BnFAD2_T05
cctctcctccctcaccctctctcctacttcgcctcgcctctctactgggcctgccagggctgcgtcctaaccggcgtctgggtcatagcccccgagtgccacgccttcagcgactacaagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgggatgttaacggttcagttcactctcggctggcctttgtacttag

SEQ ID NO: 46853 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46854 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 46855 - DNA, 353 bp, Artificial
  Mutation in BnaA.FAD2.a introduced by TALE nuclease pair BnFAD2_T05
cctctccctcaccctctctcctacttcgcctggcctctctactgggcctgccaagggtgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 46856 - DNA, 403 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcaggtggtggccatcgccagcaataatggtggcaagcaggcgctggagaaccacgccttcagcgactaccagtggctggacgacaccgtcggcctcatcttccactccttcctcctcgtcccttacttctcctggaagtacagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46857 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 46858 - DNA, 359 bp, Artificial
  Mutation in BnaA.FAD2.a introduced by TALE nuclease pair BnFAD2_T05
cctctcctccctcaccctttccattacctcgcctggcccctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaaggaccgcaacaacccgcgaggacgcacggtgatgctaaccgtccatgtcactctctgctggcctttggacttag

SEQ ID NO: 46859 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtgttacggcaagtacctcaacaacccgctaggacgcacggtgatgctaaccgtccagttcacgctcggctggcctttgtacttag

SEQ ID NO: 46860 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgctaccattccaacaccggatccctcgagagggatgaagtgttcgtccccaagaagaaatccgacatcaagtggtacggcaagtacctcaacaaccctttgggacgcaccgtgatgttaacggttcagttcactctcggctggccgttgtacttag

SEQ ID NO: 46861 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46862 - DNA, 358 bp, Artificial
  Mutation in BnaA.FAD2.a introduced by TALE nuclease pair BnFAD2_T05
cctctcctccctcaccctctccattacctcgcctggcccctctactgggcctgccaaggctgcgtcctaacgggcctctgggtcatcgcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 46863 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtttttgtccccaagaagaaatccgacatcaagtggtacggaaagtacctcaacaacccgctaggacgcacggtgatgctaaccgtccagttcacgctcggctggcctttgtacttag

SEQ ID NO: 46864 - DNA, 371 bp, Artificial
  Mutation in BnaA.FAD2.a introduced by TALE nuclease pair BnFAD2_T05
cctctcctccctcaccctctctcctacctcgcctggcctctctactgggcctgccaagggtgcgtcctaaccggcgtctgggtcatcgcccacgcctgcttgccaccgccctccccacgccttcagcgactaccagtggctggacgacaccgtcggcctcatcttccactccttcctcctcgtcccttacttctcctgtaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46865 - DNA, 350 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 46866 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcatcgaccaccagtggctgtacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46867 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgccggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46868 - DNA, 439 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatagcccacgagtgcggccattgctggcgatggccaccacctgctccggggtcaagccgtgggcctggcacagcaccggcaagcaggcgctggagagaccacgccttcagcgactaccagtggctgggcgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46869 - DNA, 352 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46870 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgcacttag

SEQ ID NO: 46871 - DNA, 359 bp, Artificial
  Mutation in BnaA.FAD2.a introduced by TALE nuclease pair BnFAD2_T05
cctctcctccctcaccctctctcctacttcgcctgacctctctactgggcctgccaagggtgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtgcctcaacaaccctttgggactcaccgtgaggttaacggttcagttcactctcggctggcctttgtacttag

SEQ ID NO: 46872 - DNA, 358 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagtgcactctcggctggcctttgtgcttag

SEQ ID NO: 46873 - DNA, 356 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 46874 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattcaaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46875 - DNA, 438 bp, Artificial
  Mutation in BnaA.FAD2.a introduced by TALE nuclease pair BnFAD2_T05
cctctcctccctcaccctatctcctacttcgcctggcctctctactgggcctgccagggctgcgtcctaaccggcgtctgggtcatagcccacgagtgcaacgatgttacgcagcagggcagtcgccctaaaacaaagttaaacattatgagggaagcggtgatcgccgaagtatcgactaccacgccttcagcgactaccagtggctggacgacaccgtcggcctcatcttccactacttcctcctcgtcccttacttctcctggaagtacagtcatcgacgccaccatcccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46876 - DNA, 432 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 46877 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggccgttgtacttag

SEQ ID NO: 46878 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggcgggcctttgtacttag

SEQ ID NO: 46879 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46880 - DNA, 430 bp, Artificial
  Mutation in BnaA.FAD2.a introduced by TALE nuclease pair BnFAD2_T05
cctctcctccctcaccctctctactacttcgcctggcctctctactgcgcctgccagggctgcgtcctaaccggcgtctgggtcatagcccacgagtgccaggcccacggcaacagccgctggaccgtctccagcgcctgcttgccaccattattgctggcgatggccacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 46881 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46882 - DNA, 356 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcacgctcggctggcctttgtacttag

SEQ ID NO: 46883 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccatggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46884 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46885 - DNA, 358 bp, Artificial
  Mutation in BnaA.FAD2.a introduced by TALE nuclease pair BnFAD2_T05
cctctcctccctcaccctctcccttacctcgcctggcccctctcctgggcctgccaaggctgcgtcctaacgggcctctgggtcatcgcccacgaatgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 46886 - DNA, 358 bp, Artificial
  Mutation in BnaA.FAD2.a introduced by TALE nuclease pair BnFAD2_T05
cctctcctccctcaccctctctcctacctcgcctggcccctctactgggcctgccaaggctgcgtcctaacgggcctctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46887 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactcgcggctggcctttgtacttag

SEQ ID NO: 46888 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtatggcaagtacctcaacaaccctttgggacgcaccgtgatgttaacggttcagttcactctcggctggcctttgtacttag

SEQ ID NO: 46889 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46890 - DNA, 350 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46891 - DNA, 356 bp, Artificial
  Mutation in BnaA.FAD2.a introduced by TALE nuclease pair BnFAD2_T05
cctctcctccctcaccctctctcctacttcgcctggcctctctcctgagcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46892 - DNA, 359 bp, Artificial
  Mutation in BnaA.FAD2.a introduced by TALE nuclease pair BnFAD2_T05
cctctcctccctcaccctctctcctacttcgcctggcctccttactgtgcctgccatctctgcgtcctaaccggcgtctgggtcatagcccacgagtgcgtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggttcggcaagtaccccaacgcccctgtgggacgtaccgggctgttaacggttccgttcactctcggctggcctttgtacttag

SEQ ID NO: 46893 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggcacggcaagtacctcaacaaccctttgggacgcaccgtgatgttaacggttcagttcactctcggctggccgttgtacttag

SEQ ID NO: 46894 - DNA, 403 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcaggtggtggccatcgccagcaataatggtggcaagcaggcgctggagaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46895 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46896 - DNA, 347 bp, Artificial
  Mutation in BnaA.FAD2.a introduced by TALE nuclease pair BnFAD2_T05
cctctcctccctcaccctctcccctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46897 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46898 - DNA, 358 bp, Artificial
  Mutation in BnaA.FAD2.a introduced by TALE nuclease pair BnFAD2_T05
cctctcctccctcaccctctcccttacctcgcctggcccctcttctgggcctgccaatgctgcgtcctaacgggcctctgggtcatcgcccacgaatgccaccacgccttcagcgaccaccagtggctggacgacgccgtgggcctcatcttccactccttcctcctcgtcccttacttctcctggaagtacagtcatcgacgccaccagtccaacactggctccctcgagagagacgaagtgtttgtccccaagaagaagtcagacatcaagtggtacggcaagtaccgcaacaaccccttgggaagcaccgtgatgttaacggttcagtgcactctcggctggcctttatacttag

SEQ ID NO: 46899 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcacggtgatgctaaccgttcagttcactctcggctggcctttgtacttag

SEQ ID NO: 46900 - DNA, 355 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 46901 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtgtctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46902 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcttcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgagggtaacggttcagttcactctcggctggcctttgtacttag

SEQ ID NO: 46903 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcatttcactcgcggctggcctttgtacttag

SEQ ID NO: 46904 - DNA, 425 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacaggcgtctgggtcatcgcccacgaatgcggccaccgccaattctggcgcttcttgttcctcgacaaccaacagataatccgatcggcccagttttaaccactccttcagcgactaccagtggctggacgacaccgtcggcctcatcttccactccttcctcctcgtcccttacttctcctggaagtacagtcatcaacgccaccattccaacactggctccctcgagagagacgaagtgtttgtccccaagaagaagtcagacatcaagtggtacggcaagtacctcaacaacccgttgggacgcaccgtggtgttaacagttcagttcacgctcggctggccttagtacttag

SEQ ID NO: 46905 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 46906 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 46907 - DNA, 346 bp, Artificial
  Mutation in BnaA.FAD2.a introduced by TALE nuclease pair BnFAD2_T05
cctctcctccctcaccctctccattacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46908 - DNA, 355 bp, Artificial
  Mutation in BnaA.FAD2.a introduced by TALE nuclease pair BnFAD2_T05
ccctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46909 - DNA, 357 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46910 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccagcactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 46911 - DNA, 362 bp, Artificial
  Mutation in BnaA.FAD2.a introduced by TALE nuclease pair BnFAD2_T05
cctctcctccctcaccctctctcctacttcgcctggcatctctactgggcctgccaatggtgcgtcctaaccggcgtctgggtcatagcccacgagtgccggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46912 - DNA, 470 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcttggcgatggcaagcaggcgctggagacggtccagcggctgttgccggtgctgtgccaggcccacggcttgaccccccagcaggtggtggccatcgccagcaataatggtggcaagcaggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 46913 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcgtcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46914 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46915 - DNA, 346 bp, Artificial
  Mutation in BnaA.FAD2.a introduced by TALE nuclease pair BnFAD2_T05
cctctcctccctcaccctctcacttacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46916 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgccctaacgggcctctgggtcatcgcccacgaatgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacgccaagtacctcaacaaccctttgggacgcaccgtgatgttaacggttcagttccctctcggctggcctttgtacttag

SEQ ID NO: 46917 - DNA, 345 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtggtgttaacggttcaggtcactctcggctggcctttgtacttag

SEQ ID NO: 46918 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggaccacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtcctcaacaaccctttgggacgcaccgtgatgttaacggttcagttcactctcggctggcctttgtacttag

SEQ ID NO: 46919 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacagcaagtggtacggcaagtacctcaacaaccctttgggacgcaccgtgatgttaacggttcagttcactctcggctggcctttgtacttag

SEQ ID NO: 46920 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggactcacggtgatgctaaccgtccagtgcacgctcggctggcctttgtacttag

SEQ ID NO: 46921 - DNA, 359 bp, Artificial
  Mutation in BnaA.FAD2.a introduced by TALE nuclease pair BnFAD2_T05
cctctactccctcaccctctctcctacttcgcctggcctatctcctgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46922 - DNA, 401 bp, Artificial
  Mutation in BnaA.FAD2.a introduced by TALE nuclease pair BnFAD2_T05
cctcttctccctcaccctctctcctacctcgcctggcccctctactgggcctgccaaggctgcgtcctaacgggcctctgggttaccgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46923 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46924 - DNA, 346 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46925 - DNA, 409 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtggcaagcaggcgctggagacggtccagcgcctgcttgccgccatcgcctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46926 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggctggacgacaccgtcggcctcatcttccactcctccctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46927 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46928 - DNA, 357 bp, Artificial
  Mutation in BnaA.FAD2.a introduced by TALE nuclease pair BnFAD2_T05
cctctcctccctcaccctctcacttacctcgcctggcccctctactgggcctgccaaggctgcgtcctaacgggcctctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46929 - DNA, 362 bp, Artificial
  Mutation in BnaA.FAD2.a introduced by TALE nuclease pair BnFAD2_T05
cctctcctccctcaccctctctcctacttctcctggcctctctactgggcctgccagggctgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagatatcaagtggtacggcaagtacctcaacaaccctttgggacgcaccgtgatgttaacggttcagttcactctcggctggcctttgtacttag

SEQ ID NO: 46930 - DNA, 424 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtacccaagaagaagtcagacatcaagtggtacggcaagtacctcaacaaccctttgggacgcaccgtgatgttaacggttcagttcactctcggctggcctttgtacttag

SEQ ID NO: 46931 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcccaaccggcgtctgggtcatagcccacgagtgcggcgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 46932 - DNA, 356 bp, Artificial
  Mutation in BnaA.FAD2.a introduced by TALE nuclease pair BnFAD2_T05
cctctcctccctcaccctctctcctacttcgcctggcatctctactgggcctgccagggctgcgtcctaactggcacagcaccggcaacagccgctggacaacgccttcagcgactaccagtggctggacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctgtgtacttag

SEQ ID NO: 46933 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgtgtcatagcccacgaaaaccacgccttaagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46934 - DNA, 350 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcacagcccacgagtgcggccagcgacaaccagtggctggacgacaccgtcggcctcatcttccactccttcctcctcgtcccttacttctcctggaagtacagtcatcgacgccaccattccaacactggctccctcgagaggggtgaagtgttcgtccccaagaagaaatccgacatcaagtggtacggaaagtaccgcaacaacccgctaaaacgcacggtgatgctaaccggccatttcacgctcggctggcctttgtgcttag

SEQ ID NO: 46935 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtccggcaagtccctcaccacccctttgggacgcaccgtgatgttaacggttccgttcactctcggctggcctttgtacttag

SEQ ID NO: 46936 - DNA, 358 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46937 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46938 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctgtacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46939 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacaacaagtggtacggaaagtacctcgacaacccgctaggacgcacggtgatgctaaccgtccagttcacgctcggctggcctttgtacttag

SEQ ID NO: 46940 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggctggacgacaccttcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatggtaacggttcagttcactctcggctggcccttgtacttag

SEQ ID NO: 46941 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46942 - DNA, 402 bp, Artificial
  Mutation in BnaA.FAD2.a introduced by TALE nuclease pair BnFAD2_T05
cctctcctccctcaccctctctcctacttcgcctgtcctctctactgggcctgccagggctgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46943 - DNA, 403 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtcgggtttcgccacctctgggggtggccatcgccagcaatggcggtgacccccccttcagcgaccaccagtggcttgaccacaccgtccgcctcatcttccactccttcctcctcgtcccttacttctcctggaagtacagtcatcgacgccaccattccacccctggctccctcgagagagacgaagtgttcgtccccaagcagaagtcagacatcacgtggtacggcaggcacctcagcatccctttgggacgcactgtggggttaacggttcagttccggctaggctggcctttgtacttag

SEQ ID NO: 46944 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatcgcccacgaatgccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46945 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 46946 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaaaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46947 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 46948 - DNA, 360 bp, Artificial
  Mutation in BnaA.FAD2.a introduced by TALE nuclease pair BnFAD2_T05
cctctcctccctcaccctctctcctacttcgcctggactcactactgggcctgccaagggcgcgtcctaaccggcgtctgggtcatagcccacgagtgcggcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacagcaagtggtacggcaagtacctcaacagccctttgggacgcgccgggatgttaactgttcagttcactctcggctggcctttgtacttag

SEQ ID NO: 46949 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 46950 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46951 - DNA, 358 bp, Artificial
  Mutation in BnaA.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46952 - DNA, 402 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcttcccctggagagagcgagattctccgcgctgtagaagtcacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 46953 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatgcctctgggacgcaccgtgatgttaaccgttcagttccctctcggctggcctttgtacttag

SEQ ID NO: 46954 - DNA, 342 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46955 - DNA, 358 bp, Artificial
  Mutation in BnaA.FAD2.a introduced by TALE nuclease pair BnFAD2_T05
cctctcctccctcaccctctctcctacttcgcctgggctctctactgggcctgccagggctgcgtcctaaccggcgtctgggtcatagcccacgagtgcggccacggcttcagcgactaccagtggctggacgacaccgtcggcctcatcttccactccttcctcctcgtcccttacctctcctggaagtacagtcatcgacgccaccattccaacactggctccctcgagagagacgaagtgtttgtccccaagaagaaatccgacatcaagtggtacggaaagtacctcaacaacccgctaggacgcccggtgatgctaaccgtccagttcacgctcggctggcatttgtacttag

SEQ ID NO: 46956 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttgcttctcctggaagtacagtcatcgacgccaccattccaacactggctccctcgagagagacgaagtgtttgtccccaagaagaagtcagacatcaagtggtacggcaaggacctcaacaacccgttggaacgcaccgtgatgttaacggttgagttcactctcggctggccggtgtacttag

SEQ ID NO: 46957 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46958 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46959 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggccatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46960 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46961 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46962 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 46963 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacggcttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46964 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagtgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 46965 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46966 - DNA, 402 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46967 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaactggtacggcaagtacctcaacaaccctttgggacgcaccgtgatgttaacggttcagttcactctcggctggcctttgtacttag

SEQ ID NO: 46968 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 46969 - DNA, 362 bp, Artificial
  Mutation in BnaA.FAD2.a introduced by TALE nuclease pair BnFAD2_T05
cctctcctccctcaccctctcacttacctcgcctggcccctctactgggcctgccaaggctgcgtcctaacgggcctctgggtcatagcccacgagtgcggtccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46970 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46971 - DNA, 351 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46972 - DNA, 350 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagccctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46973 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46974 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 46975 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 46976 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatcgcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46977 - DNA, 396 bp, Artificial
  Mutation in BnaA.FAD2.a introduced by TALE nuclease pair BnFAD2_T05
cctctcctccctcaccctctctcctacttcgcctggcctctctactgggccatcgccagcaataatggaggcaagcaggcgctggagacggtccagcggctgttgccggtgctgtgccaggcccacggcttgacccccaccacgccttcagcgactaccagtggctggacgacaccgtcggcctcatcttccactccttcctcctcgtcccttacttctccttgaagtacagtcatcgacgccaccattccaacactggctccctcgagagagacgaattgtttgtccccaagaagaagtcagacatcaagtggtacggcaagtacctcaacaaccctttgggacgcaccgtgatgttaaccgttcagttcactctcggctggcctttgtacttag

SEQ ID NO: 46978 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46979 - DNA, 447 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatcgcccacgaatgctgcttgccaccgccattgctggcgatggccaccacctgctggggggtcaagccgtgggcctggcacagcaccggcaacagccgctggaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 46980 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 46981 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcataaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46982 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccatggctgcgtcctaaccggcgtctgggtcatagcccacgagtgcggtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46983 - DNA, 471 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcttggcgatggcaagcaggcgctggagacggtccagcggctgttgccggtgctgtgccaggcccacggcttgaccccccagcaggtggtggccatcgcccgcaatcatggtggcaagcaggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46984 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctgggcgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46985 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcacgcttggctggcctttgtacttag

SEQ ID NO: 46986 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 46987 - DNA, 358 bp, Artificial
  Mutation in BnaA.FAD2.a introduced by TALE nuclease pair BnFAD2_T05
cctctcctccctcaccctctctcctacttcgcctggcctccctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 46988 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgccccgtgatgttaaccgttcagttcactctcggctggcctttgtacttag

SEQ ID NO: 46989 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaacgggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 46990 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46991 - DNA, 359 bp, Artificial
  Mutation in BnaA.FAD2.a introduced by TALE nuclease pair BnFAD2_T05
cctctcctccctcaccctctctcctacttcgcctggcccctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgagacgcaccgtggtgttaaccgttcggttcactctcggctggcctttgtgcttag

SEQ ID NO: 46992 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 46993 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46994 - DNA, 344 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 46995 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccgccaccacgccttcagcgactaccagtggctggacgacaccgtcggcctcatcttccactccttcctcctcgtcccttacttctcctggaagtacagtcatcgacgccaccattccaacactggctccctcgagagaggcgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46996 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 46997 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 46998 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacctgcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 46999 - DNA, 358 bp, Artificial
  Mutation in BnaA.FAD2.a introduced by TALE nuclease pair BnFAD2_T05
cctctcctccctcaccctctctcctacttcgcctggcctcactactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcgcggtgatgctaaccgtccagttcacgctcggctggcctttgtacttag

SEQ ID NO: 47000 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgacttag

SEQ ID NO: 47001 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 47002 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47003 - DNA, 425 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaccgccattgctggcgatgagcgttcaccgacaaacaacagataaaacgaaaggcccagtcttaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 47004 - DNA, 333 bp, Artificial
  Mutation in BnaA.FAD2.a introduced by TALE nuclease pair BnFAD2_T05
cctctcctccctcaccctctctcctacttcgcctgggctctctactgggcctgccaagggagcgtcctaaccggcgtctgggtcatagcccacgaatgtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaacccgttgggacgcaccgtgatgttaacgtttcagttcactctcggctggcctgagtacttag

SEQ ID NO: 47005 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 47006 - DNA, 447 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccgccattgctggcgatggccaccacctgctggggggtcaagccgtgggcctggcacagcaccggcaacagccgctggaccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47007 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47008 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaaccgtccagttcactctcggctggcctttgtacttag

SEQ ID NO: 47009 - DNA, 339 bp, Artificial
  Mutation in BnaA.FAD2.a introduced by TALE nuclease pair BnFAD2_T05
ctctcctccctcaccctctctcctacttcgcctggcctctctactgggcctgccagggctgcgtcctaaccggcgtctgggtcatagcccacgagtgctaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctgtgtacttag

SEQ ID NO: 47010 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtgttacggcaagtacctcaacaaccctttgggacgcaccgtgatgttaacggttcagttcactctcggctggcctttgtacttag

SEQ ID NO: 47011 - DNA, 360 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47012 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagtcatcgacgccaccattccaacacttgctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47013 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgtaaacggttcagttcactctcggctggcctttgtacttag

SEQ ID NO: 47014 - DNA, 419 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 47015 - DNA, 419 bp, Artificial
  Mutation in BnaA.FAD2.a introduced by TALE nuclease pair BnFAD2_T05
cctctcctccctcaccctctcccttacctcgcctggaccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47016 - DNA, 353 bp, Artificial
  Mutation in BnaA.FAD2.a introduced by TALE nuclease pair BnFAD2_T05
cctctcctccctcaccctctctcctacttcgcctggcctctctactgagcctgccagggctgcgtcctaaccggcgtctgggtcatagcccacgaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggccggcctgtgtacttag

SEQ ID NO: 47017 - DNA, 358 bp, Artificial
  Mutation in BnaA.FAD2.a introduced by TALE nuclease pair BnFAD2_T05
cctctcctccctcaccctctctcctacttcgcctggcctctctactgtgcctgacagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 47018 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47019 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttggggcgcaccgtgatgttaacggttcagttcactctcggctggcctttgtacttag

SEQ ID NO: 47020 - DNA, 358 bp, Artificial
  Mutation in BnaA.FAD2.a introduced by TALE nuclease pair BnFAD2_T05
cctctcctccctcaccctctctcctacttcgcctggcctctctcctgggcctgccagggacgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcgagtacctcaacaaccctttgggacgcaccgtgatgttaacggttcagttcactctcggctggcctttgtacttag

SEQ ID NO: 47021 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47022 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47023 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgaccaccagtggctggacgacgccgtgggcctcgtcttccactccttcctcctcgtcccttacttctcctggaagtacagtcatcgacgccaccattccaacactggatccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 47024 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47025 - DNA, 355 bp, Artificial
  Mutation in BnaA.FAD2.a introduced by TALE nuclease pair BnFAD2_T05
cctctcctccctcaccctctctcctacttcgcctggcctctctacttggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaactgttcagttcactctcggctggcctttgtacttag

SEQ ID NO: 47026 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47027 - DNA, 359 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 47028 - DNA, 362 bp, Artificial
  Mutation in BnaA.FAD2.a introduced by TALE nuclease pair BnFAD2_T05
cctctcctccctcaccctctcccttacctcgcctggccactctactgggcctgccaaggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 47029 - DNA, 358 bp, Artificial
  Mutation in BnaA.FAD2.a introduced by TALE nuclease pair BnFAD2_T05
cctctcctccctcaccctctctcctacttcgcctggaatacctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggtgcaggtcactctcggctggcctttgtacttag

SEQ ID NO: 47030 - DNA, 358 bp, Artificial
  Mutation in BnaA.FAD2.a introduced by TALE nuclease pair BnFAD2_T05
cctctcctccctcaccctctcccttacctcgcctggcgcctctactgggcctgccaaggctgcgtcctaacgggcctctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47031 - DNA, 362 bp, Artificial
  Mutation in BnaA.FAD2.a introduced by TALE nuclease pair BnFAD2_T05
cctctcctccctcaccctctctcctacttcgcctggcctctctaatgggcctgccagggctgcgtcctaaccggcgtctgggtcatagcccacgagtgcgggccaccacgccttcagcgactaccagtggctggacgacaccggcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccttttgggacgcaccgtgatgttaacggtgcagttcacttgcggcgggcctgtgtacttag

SEQ ID NO: 47032 - DNA, 358 bp, Artificial
  Mutation in BnaA.FAD2.a introduced by TALE nuclease pair BnFAD2_T05
cctctcctccctcaccctctcacttacctcgcctggcccctctactgggcctgacaaggctgcgtcctaacgggcctctgggtcatcgcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47033 - DNA, 333 bp, Artificial
  Mutation in BnaA.FAD2.a introduced by TALE nuclease pair BnFAD2_T05
cctctcctccctcaccctctctcctacttcgcctggcctttctactgggcctgagcaggttattgctggggggccaccacgccttcagcgactaccagtggctggacgacaccgtctgcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttagcggtgcagttcactcgcggctggcctttgtacttag

SEQ ID NO: 47034 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47035 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47036 - DNA, 410 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatattggtggcaagcaggcgctggagacggtgcaggcgctgttgccggtgctgtgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47037 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47038 - DNA, 346 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47039 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 47040 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgttatgttaacggttcagttcactctcggctggcctttgtacttag

SEQ ID NO: 47041 - DNA, 356 bp, Artificial
  Mutation in BnaA.FAD2.a introduced by TALE nuclease pair BnFAD2_T05
cctctcctccctcaccctctctcctacttcgcctggcatacttactgagcctgccagggctgcgtcctaactggcacagcaccggcaacagccgctggacaacgccttcagcgactaccagtggctggacggcaccgtcggcctcatcttccactccttcctcctcgtcccttacttctcctggaagtacagtcatcgacgccaccattccaacactggctccctcgagagagacgacgtgtttgtccccaagaagaagacagacaacgagtggtacggcaagtccatcaacacccttttgggtcgcaccgggatgttaacgttgcagttcacttgcggctggcctttatacttag

SEQ ID NO: 47042 - DNA, 362 bp, Artificial
  Mutation in BnaA.FAD2.a introduced by TALE nuclease pair BnFAD2_T05
cctctcctccctcaccctctaccttacctcgcctggcacatctaatgggcctgccaaggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47043 - DNA, 359 bp, Artificial
  Mutation in BnaA.FAD2.a introduced by TALE nuclease pair BnFAD2_T05
cctctcctccctcaccctctaccttacctcgcctggcccctctactgggcctgccaaggctgcgtcctaacggccctctgggtcatcgcccacgaatgcggaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtgccacaccaaccctttgggacgcaccgtgatgttaacggttcagttcactctcgggtgtcctttgtacttag

SEQ ID NO: 47044 - DNA, 354 bp, Artificial
  Mutation in BnaA.FAD2.a introduced by TALE nuclease pair BnFAD2_T05
cctctcctccctcaccctctcccttacctcgcctggcccctctaatgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 47045 - DNA, 358 bp, Artificial
  Mutation in BnaA.FAD2.a introduced by TALE nuclease pair BnFAD2_T05
cctctcctccctcaccctctctcctacttcgcctgccctctctcctgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47046 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttccctctcggctggcctttgtacttag

SEQ ID NO: 47047 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgtttgtccccaagaagaagtcagacatcaagtggtacggcaagtacctcaacagccctttgggacgcaccgtgatgttaacggttcagttcactctcggctggcctttgtacttag

SEQ ID NO: 47048 - DNA, 358 bp, Artificial
  Mutation in BnaA.FAD2.a introduced by TALE nuclease pair BnFAD2_T05
cctctcctccctcaccctccctcctacttcgcctggcctctctactgggcctgccaagggtgcgtcctaaccggcgtctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47049 - DNA, 353 bp, Artificial
  Mutation in BnaA.FAD2.a introduced by TALE nuclease pair BnFAD2_T05
cctctcctccctcaccctctatcctacttcgcctggcctatttcatgggcctgacagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacaacaagtggtccggcaagtacctcaccaaccctttgggacgcaccggaaagctaacggtgcagttcgctctcggctggcctttgtacttag

SEQ ID NO: 47050 - DNA, 443 bp, Artificial
  Mutation in BnaA.FAD2.a introduced by TALE nuclease pair BnFAD2_T05
cctctcctccctcaccctctcccttacctcgcctggcccctctcctgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttcgcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcatttcactcgcggctggcctttgtacttag

SEQ ID NO: 47051 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47052 - DNA, 358 bp, Artificial
  Mutation in BnaA.FAD2.a introduced by TALE nuclease pair BnFAD2_T05
cctctcctccctcaccctctctcctacttcgcctggactctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47053 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacccgcgtctgggtcatagcccaccacgccttcagcgactaccagtggctggacgacaccgtcggcctcatcttccactccttcctcctcgtcccttacttctcctggaagtacagtcctcgacgccaccataccaacactgcctccctcgagagggatgaagtgtacgtccccaagaagaaagccgacatcaagtggtacggaaaataccgcaacaacccgctaggacgcacgttgatgctaaccgtacatgtcacgctcgtccggcatttgtacttag

SEQ ID NO: 47054 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcgtctggcctttatacttag

SEQ ID NO: 47055 - DNA, 361 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagacaggcagaaatctcgtatgccgccttctgcttgtaaaaaaaaccgtcggcctcatcttccactccttcctcctcgtcccttacttctcctggaagtacagtcatcgacgccaccattccaacactggctccctcgagagagacgaattgtttgtccccaagaagaagtcagacatcaagtggtacggcaagtacctcaacaaccctttgggacgcaccgtgatgttaacggttcagttcactctcggctggcctttgtacttag

SEQ ID NO: 47056 - DNA, 359 bp, Artificial
  Mutation in BnaA.FAD2.a introduced by TALE nuclease pair BnFAD2_T05
cctctcctccctcaccctctatcctacttcgcctggcctctctactgcgcctgccaagggagcgtcctaaccggcatctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacaaccctttgggacgcaccgtgatgttaacggttcagttcactctcggctggcctttgtacttag

SEQ ID NO: 47057 - DNA, 357 bp, Artificial
  Mutation in BnaA.FAD2.a introduced by TALE nuclease pair BnFAD2_T05
cctctcctccctcaccctctctcctacttcgcctggaatacctcatgagcctgccagggctgcgtcctaaccggcgtctgggtcatagcccacgagtgcaccacgccttcagcgactaccagtggcttgacgacaccgtcggtctcatcttccactccttcctcctcttcccttacttctcctggaagtacagtcatcgacgccaccattccaacactggctccctcgagagagacgaagggtttgtccccaagaagaagtcagacatcaagtggtacggcaagtacctcaacaaccctttgggacgcaccgtgatgttaacggtgcaggtcactcgcggctggcctgtgtacttag

SEQ ID NO: 47058 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47059 - DNA, 358 bp, Artificial
  Mutation in BnaA.FAD2.a introduced by TALE nuclease pair BnFAD2_T05
cctctcctccctcaccctctcccttacctcgcctggcacctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47060 - DNA, 358 bp, Artificial
  Mutation in BnaA.FAD2.a introduced by TALE nuclease pair BnFAD2_T05
cctctcctccctcaccctctctcctacttcgcctggcctctctaatgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttagggacgcaccgtgatgttaacggttcagttcactctcggctggcctttgtacttag

SEQ ID NO: 47061 - DNA, 362 bp, Artificial
  Mutation in BnaA.FAD2.a introduced by TALE nuclease pair BnFAD2_T05
cctctcctccctcaccctctctcctacttcgcctggcctctctactgagcctgccagggctgcgtcctaaccggcgtctgggtcatagcccacgagtgcgggccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47062 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 47063 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgcgcggctggcctttgtacttag

SEQ ID NO: 47064 - DNA, 435 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcattgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggcgggcctttgtacttag

SEQ ID NO: 47065 - DNA, 283 bp, Artificial
  Mutation in BnaA.FAD2.a introduced by TALE nuclease pair BnFAD2_T05
cctctcctccctcaccctctcccttaccacgccttcagcgaccaccagtggcgggacgacaccggcggcctcatcttccactccttcctcctcgtaccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47066 - DNA, 443 bp, Artificial
  Mutation in BnaA.FAD2.a introduced by TALE nuclease pair BnFAD2_T05
cctctcctccctcaccctctctcctacttcgcctggactctctactgggcctgccagggctgcgtcctaaccggcgtctgggtcatagcccacgagtgcctcaagccgtgggcctggtccagcggctgttgccaccgccattgctggcgatggccaccacctgctggggggtcaagccgtgtgccaccacgccttcagcgaccaccagtgcctggacgacaccgtcggcctcatcttccactccttcctcctcgtcccttacttctcctggaagtacagtcatcgacgccaccattccaacactggctccctcgagagacacgaagtgtttgtccccaagaagaagtcagacatcaagtggtacgccaagtacctcaacacccctttgggacgcaccgtgatgttaacggatcagttcactctcggctggcctttgtacttag

SEQ ID NO: 47067 - DNA, 362 bp, Artificial
  Mutation in BnaA.FAD2.a introduced by TALE nuclease pair BnFAD2_T05
cctctcctccctcaccctctctcctacttcgcctggcacctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacaaccctttgggacgcaccgtgatgttaaccgttcagttcactctcggctggcctttgtgcttag

SEQ ID NO: 47068 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47069 - DNA, 287 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactcgcggctggcctttgtacttag

SEQ ID NO: 47070 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47071 - DNA, 362 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47072 - DNA, 353 bp, Artificial
  Mutation in BnaA.FAD2.a introduced by TALE nuclease pair BnFAD2_T05
cctctcctccctcaccctctcgcttacctcgcctggcccctcttctgggcctgccaaggctgcgtcctaacgggcctctgggtcatcgcccacgcaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacatcccttttggacgcgccgtgatgttaacggtgcatgtcgctcgtggcgggcctgtttacttag

SEQ ID NO: 47073 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgcgcggctggcctttgtacttag

SEQ ID NO: 47074 - DNA, 353 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaaccctttgggacgcaccgtgatgttaacggtgcagttcactctcgcctggcctttgtacttag

SEQ ID NO: 47075 - DNA, 358 bp, Artificial
  Mutation in BnaA.FAD2.a introduced by TALE nuclease pair BnFAD2_T05
cctctcctccctcaccctctcccttacctcgcctggcctctttaatgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggcaagtacctcaacaaccctttgggacgcaccgtgatgttaacggtgcaggtcactctcggctggcctttgtacttag

SEQ ID NO: 47076 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggccggcctttgtacttag

SEQ ID NO: 47077 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctgtacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 47078 - DNA, 444 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagatcaatgtcgaccgcggctggctcgaagatacctgcaagagcctcatattccctcccattccaaatactctgcaccggacctccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtacggcaagtaccccaacaaccctttgggacgcaccgtgatgttaacggttcagttcactctcggctggcctttgtacttag

SEQ ID NO: 47079 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 47080 - DNA, 362 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcatagcccacgagtgccggccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47081 - DNA, 435 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47082 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagctactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47083 - DNA, 418 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggcgatggccaccacctgctggggggtcaagccgtggggtcaagccgtgggcctggcacagcaccggcaacagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactcgcggctggcctttgtacttag

SEQ ID NO: 47084 - DNA, 347 bp, Artificial
  Mutation in BnaA.FAD2.a introduced by TALE nuclease pair BnFAD2_T05
cctctcctccctcaccctctatcctacttcgcctggcctctctaatgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 47085 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagtccacgagtgcggccagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 47086 - DNA, 438 bp, Artificial
  Mutation in BnaA.FAD2.a introduced by TALE nuclease pair BnFAD2_T05
cctctcctccctcaccctctctcctacttcgcctggactctctactgggcctgccagggctgcgtcctaaccggcgtctgggtcatagcccacgagtgcaacgatgttacgcagcagggcagtcgccctaaaacaaagttaaacattatgagggaagcggtgatcgccgaagtatcgactaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctagccttccagttcacgctcgtctggcctgtgtacttag

SEQ ID NO: 47087 - DNA, 359 bp, Artificial
  Mutation in BnaA.FAD2.a introduced by TALE nuclease pair BnFAD2_T05
cctctcctccctcaccctctatcctacttcgcctggcctctctactgggcctgacagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 47088 - DNA, 358 bp, Artificial
  Mutation in BnaA.FAD2.a introduced by TALE nuclease pair BnFAD2_T05
cctctcctccctcaccctctctcctacttcgcctggcctctctcctgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47089 - DNA, 347 bp, Artificial
  Mutation in BnaA.FAD2.a introduced by TALE nuclease pair BnFAD2_T05
cctctcctccctcaccctctgtcctacttcgcctggcctctctactgggcctgccaagggtgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaacggttcagttcactcgcggctgccctttgtacttag

SEQ ID NO: 47090 - DNA, 333 bp, Artificial
  Mutation in BnaA.FAD2.a introduced by TALE nuclease pair BnFAD2_T05
cctctcctccctcaccctctctcctacttcgcctggcctctctactaggcctgagcaggttattgctggggggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47091 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47092 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatcgcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47093 - DNA, 357 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47094 - DNA, 346 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47095 - DNA, 363 bp, Artificial
  Mutation in BnaA.FAD2.a introduced by TALE nuclease pair BnFAD2_T05
cctctcctccctcaccctctctcctacttcgccttgcctctctactgggcctgcccgggctgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctctgggacgcaccgtgatgttaccggttcagttcactctcggctggcctttgtacttag

SEQ ID NO: 47096 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacggaccgtgattttaacgcgtcagttgactcccgccgggcctttgtccttag

SEQ ID NO: 47097 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47098 - DNA, 419 bp, Artificial
  Mutation in BnaA.FAD2.a introduced by TALE nuclease pair BnFAD2_T05
cctctcctccctcaccctctaccttacctcgcctggcctctctactgggcctgccagggctgcgtcctaaccggcgtctgggtcatagcccacgagtgcggccagcggtacgcgtattaattgcgttgcgctcactgcccgcaaaaggccagcaaaaggccaccacgccttcagcgactaccagtggctggacgacaccgtcggcctcatcctccactccttcctcctcgtcccttacttctcctgaaagtacagccatcgacgccaccagtccaacaccggatccctcgagaggaatgaagtgtacgtccccaagaagaaatccaacatcaagtggtacgggaagggcctcaacaacccttagggacgcacagtgatgttaacgagacagttctctcacggatggcctgtgtacttag

SEQ ID NO: 47099 - DNA, 355 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47100 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 47101 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcacgcgcggccgccctttgtacttag

SEQ ID NO: 47102 - DNA, 424 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcggtatcagaggcagttggcgccatcgagcgccatctcgcaccgacgttgctggccgtacatttgtacaccacgccttcagcgactaccagtggcgggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47103 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47104 - DNA, 329 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47105 - DNA, 331 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcttggcctttgtacttag

SEQ ID NO: 47106 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcggctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47107 - DNA, 360 bp, Artificial
  Mutation in BnaA.FAD2.a introduced by TALE nuclease pair BnFAD2_T05
cctctcctccctcaccctctgacctacttcgcctggaatctctcctgagcctgacagggctgcgtcctaaccggcgtctgggtcatagcccacgagtgcgccaccacgccttcagcgactaccagtggctggacgacaccgtcggcctcatcttccactccttcctccccgtcccttacttctcctggaagtacaggcatcgacgccaccattccaacactggctccctcgagagagacgaagtgtttgtccccaagaagaagtcagacatcaagtggtacggcaagtacctcaacaaccctctgggacgcaccgggatgttaacgttgcatgtcactcgcggctggcctttgtacttag

SEQ ID NO: 47108 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcctcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctttgtacttag

SEQ ID NO: 47109 - DNA, 356 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47110 - DNA, 349 bp, Artificial
  Mutation in BnaA.FAD2.a introduced by TALE nuclease pair BnFAD2_T05
cctctcctccctcaccctctctcctacttcgcctggcatacctccttggcctgccagggctgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47111 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacacagtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47112 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 47113 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47114 - DNA, 280 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 47115 - DNA, 450 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcggctgttgccggtgctgtgccaggcccacggcttgaccccccgctccggggtctggccatcgccagccacgatggcggcaacagccgctggacccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47116 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggccgcgtcctaaccggcgtctgggtcatagcccacgagccaccacgccttcagcgactaccagtgactggacgacgccgtcggcctcatcttccactccttcctcctcgtcccttacttctcctggaagtacagtcatcgacgccaccataccaacactggctccctcgagagagacgaagtgtttgtccccaagaagaagtcagacagcaagtggtacggcaagtacctcaacaaccctttgggacgcaccgtgatgttaacggttcagttcactcgcggctggcctttgtacttag

SEQ ID NO: 47117 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaaatcagacatcaagtggtacggcaagtacctcaacaaccctttgggacgcaccgtgatgttaacggttcagttcactcgcggctggcctttgtacttag

SEQ ID NO: 47118 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagtgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagccagacatcaagtggtacggaaagtacctcaacaacccgctaggacgcacggtgatgctaaccgtccagttcacgcccggctggcctttgtacttag

SEQ ID NO: 47119 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47120 - DNA, 450 bp, Artificial
  Mutation in BnaA.FAD2.a introduced by TALE nuclease pair BnFAD2_T05
cctctcctccctcaccctctatcctacttcgcctggcctctataatgggcctgacagggctgcgtcctaaccggcgtctgggtcatagcccacgagcggctgttgcgggtgctgtgccaggcccacggcgtgacccgacgctccggggtctggccatcgccagccacgagggtggcaacagacgctgggcccagcaagccttcggcgactaccagtggctagaagacaccgtcggcctcatcttccactccttcctcctcgtccctgacttcgcctgggagtacagtcatcgacgccaccatgccaacactggctccctcgagagagacgaattgtgtgtccccacgaagaaggcagacatcaagtggtacggcgagtacctcaacaacccttatggacgcaccgtgatggtaacggttcagttctctcacggctggcctttgtacttag

SEQ ID NO: 47121 - DNA, 358 bp, Artificial
  Mutation in BnaA.FAD2.a introduced by TALE nuclease pair BnFAD2_T05
cctctcctccctcaccctctctcctacttcgcctggcctctctactgggcctgacagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47122 - DNA, 358 bp, Artificial
  Mutation in BnaA.FAD2.a introduced by TALE nuclease pair BnFAD2_T05
cctctcctccctcaccctctatcctacttcgcctggcccctctaatgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47123 - DNA, 358 bp, Artificial
  Mutation in BnaA.FAD2.a introduced by TALE nuclease pair BnFAD2_T05
cctctcctccctcaccctctctcctacttcgcctggcctacctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47124 - DNA, 353 bp, Artificial
  Mutation in BnaA.FAD2.a introduced by TALE nuclease pair BnFAD2_T05
cctctcctccctcaccctctctcctacttctcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 47125 - DNA, 419 bp, Artificial
  Mutation in BnaA.FAD2.a introduced by TALE nuclease pair BnFAD2_T05
actctcctccctcaccctctctcctacttcgcctggcctctctactgggcctgccagggctgcgtcctaaccggcgtctgggtcatagcccacgagtgcggccagcggtacgcgtattaattgcgttgcgctcactgcccgcaaaaggccagcaaaaggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47126 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47127 - DNA, 329 bp, Artificial
  Mutation in BnaA.FAD2.a introduced by TALE nuclease pair BnFAD2_T05
cctctcctccctcaccctctctcctacttctcctgacctctctactgggcctgccagagctgcgtcctaaccggcgtcggggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaataagaagtcagacatcaagtggtacggcaagtaccccaacaccctcttgggcagcgccgtgttggtatcggttacgtccactcccggttgcctgtggtccgtaa

SEQ ID NO: 47128 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacgccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 47129 - DNA, 447 bp, Artificial
  Mutation in BnaA.FAD2.a introduced by TALE nuclease pair BnFAD2_T05
cctctcctccctcaccctctctcctacttcgcctggcctctctcctgagcctgccaagggtgcgtcctcaccggcgtctgggtcatagcccacgagtgcggccaggcccacggcttgaccccggagcaggtggtgcaattaatacgcgtaccgctagccaggacgagtttgtagaaacgcaaaaaggccaccacgccttcagcgactaccagtgcctggacgacaccgtcggcctcatcttccactccttcctcctcgtcccttacctctcctggaagtacagtcatcgacgccaccatcccaacactggctccctcgagagagacgaagtgtttgtccccaagaagaagtcacacatcaagtggtacggcgagttccccagcaaccgtctgggagggaccgtgagtctaagggctcggttccctcccggctggctttagtgcttag

SEQ ID NO: 47130 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggatcagttcactctcggctggcctttgtacttag

SEQ ID NO: 47131 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcttgcctttgtacttag

SEQ ID NO: 47132 - DNA, 432 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgcggcctctcgccctgatccggcgttggccgcgttgaccaacgaccacctcgtcaccttggcctgcctcggcgggccaccacgccttcagcgaccaccagtggctggacgacgccgtgggcctcgtcttccactccttcctcctcgtcccttacttctcctggaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47133 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47134 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 47135 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 47136 - DNA, 450 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcggctgttgccggtgctgtgccaggcccacggcttgaccccccgctccggggtctggccatcgccagccacgatggcggcaacagccgctggacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47137 - DNA, 353 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47138 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccattggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcatgtacctcaacaaccctttgggacgcaccgtgatgttaacggttcagttcactctcggctggcctttgtacttag

SEQ ID NO: 47139 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggcgggcctttgtacgtag

SEQ ID NO: 47140 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47141 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47142 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47143 - DNA, 355 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47144 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47145 - DNA, 425 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaccgccattgctggcgatgagcgttcaccgacaaacaacagataaaacgaaaggcccagtcttaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47146 - DNA, 345 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcaccacgccttcaacgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47147 - DNA, 402 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47148 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47149 - DNA, 410 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatattggtggcaagcaggcgctggagacggtgcaggcgctgttgccggtgctgtgccaccacgccttcagcgaccaccagtggctggacgacgccgtgggcctcgtcttccactccttcctcctcgtcccttacttctcccggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47150 - DNA, 350 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47151 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacaccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47152 - DNA, 356 bp, Artificial
  Mutation in BnaA.FAD2.a introduced by TALE nuclease pair BnFAD2_T05
cctctcctccctcaccctctcccttacctcttctggcccctctactggtcctgccatgtctgcgtcctaactggcacagcaccggcaacagccgctggacaacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacgcgcctgagggacacaccgtgctgtttacggttcagttcactctcggctggcctttgtacttag

SEQ ID NO: 47153 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaactggcacagcaccggcaacagccgctggacaacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47154 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 47155 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaatgcggcgccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47156 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccactagtgcaccacgccttcagcgactaccagtggctggacgacaccgtcggcctcatcttccactccttcctcctcgtcccttacttctcctggaagtacaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47157 - DNA, 396 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaggtggtggccatcgccaccacctgctccgccgctggaccgtctccgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47158 - DNA, 433 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcggcaaacaaaccaccgctggtagcggtggtttttttgtttgcaagcagcagattacgcgcagaaaaaaaggacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47159 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgggagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 47160 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47161 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47162 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgacgaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 47163 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 47164 - DNA, 438 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccattgctggcgatggccaccacctgctccggggtcaagccgtgggcctggcacagcaccggcaacagccgctggagagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47165 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47166 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47167 - DNA, 450 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagcggctgttgccggtgctgtgccaggcccacggcttgaccccccgctccggggtctggccatcgccagccacgatggcggcaacagccgctggacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47168 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcgaccacgccttcagcgactaccagtggctggacgacaccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47169 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 47170 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcacacatcaagtggtactgcaagtacctcaacaaccctttgggacgcaccgtgatgttaacggttcagttcactctcggctgccctttgcacttag

SEQ ID NO: 47171 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47172 - DNA, 349 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctaaacaaccctttgggacgcaccgtgatgttaacggttcagttcactctcggctggcctttgtacttag

SEQ ID NO: 47173 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47174 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacgtag

SEQ ID NO: 47175 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaattacagtcatcgacgccaccattccaacactggctccctcgagagagacgaagtgtttgtccccaagaagaaggcagacatcaagtggtacggcaagtacctcaacaaccctttgggacgcaccgtgatgttaacggttcatgtcactctcgggtggccttggtacttag

SEQ ID NO: 47176 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 47177 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47178 - DNA, 358 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47179 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttacttag

SEQ ID NO: 47180 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcagcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcatttcactctcggctggcctttgtacttag

SEQ ID NO: 47181 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47182 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 47183 - DNA, 357 bp, Artificial
  Mutation in BnaA.FAD2.a introduced by TALE nuclease pair BnFAD2_T05
cctctcctccctcaccctctctcctacttcgcctggcctctctcctgagcctgccagggctgcgtcccaacaggcgtctgggtcatagcccacgagtgcaccacgccttcagcgactaccagtggctggacgacaccgtcggcctcatcttccactccttcctcctcgtcccttacttctcctggaagtacagtcctcgacgccaccattccaacactggctccctcgagagagacgaagtgtttgtccccaagaagaagtcagacatcaagtggtacggcaagtacctcaacaaccctttgggacgcaccgtgaggttaacggttcaggtcagtctcggctgcccttagtacttag

SEQ ID NO: 47184 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47185 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcctcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggactttgtacttag

SEQ ID NO: 47186 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47187 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcttaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47188 - DNA, 353 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47189 - DNA, 357 bp, Artificial
  Mutation in BnaA.FAD2.a introduced by TALE nuclease pair BnFAD2_T05
ccttcctccctcaccctctcccttacctcgcctggcccctctactgggcctgccaaggctgcgtcctaacgggcctctgggtcatcgcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47190 - DNA, 329 bp, Artificial
  Mutation in BnaA.FAD2.a introduced by TALE nuclease pair BnFAD2_T05
cctctcctccctcaccctctctcctacttcgcctggcctctctactgggcctgccagggctgcatcctaaccggcgtctgggtcatagcccacgagtgcggacgacaccgtcggcctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtccttag

SEQ ID NO: 47191 - DNA, 329 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggacgacaccgtcggcctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47192 - DNA, 354 bp, Artificial
  Mutation in BnaA.FAD2.a introduced by TALE nuclease pair BnFAD2_T05
cctctcctccccaccctctctcctacttcgcctggcctctctacttggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 47193 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctcaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 47194 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttatcggttcagttctctctcggctggcctttgtacttag

SEQ ID NO: 47195 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctagaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47196 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctacctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47197 - DNA, 443 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacaccgtcggtctcatcttccactccttcctcctcgtcccttacttctcctggaagtacagtcatcgacgccaccactccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 47198 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47199 - DNA, 394 bp, Artificial
  Mutation in BnaA.FAD2.a introduced by TALE nuclease pair BnFAD2_T05
cctctcctccctcaccctctcacttacctcgcctggcccctctactgggcctgccaaggctgcgtcctaccgggcctctgggtcatcgcccacgaatgcgacaaacaacagataaaacgaaaggcccagtcttcccaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctttgtacttag

SEQ ID NO: 47200 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtcttag

SEQ ID NO: 47201 - DNA, 363 bp, Artificial
  Mutation in BnaA.FAD2.a introduced by TALE nuclease pair BnFAD2_T05
cctctcctccctcaccctctctcctacttcgcctggcctctctcctgagcctgccagggctgcgtcctaaccggcgtctgggtcatagcccacgagtgccccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctgtgtacttag

SEQ ID NO: 47202 - DNA, 356 bp, Artificial
  Mutation in BnaA.FAD2.a introduced by TALE nuclease pair BnFAD2_T05
cctcttctccctcaccctctctcctacttcgcctggcctctctactgggcctgccagggctgcgtcccaacaggcgtctgggtcatagcccacgagccaccacgccttcagcgactaccagtggctggacgacaccgtcggcctcatcttccactccttcctcctcgtcccttacttctcctggaagtacagtcatcgacgccaccattccaaccctggctccctcgagagggattaagtgttcgtcccctagaagaaatcccacatcaagtcgtacggcaactacctcagcatccgtttgggacgcaccgtgaggctaacggggcaattcactcccggccgccctgagtgcttag

SEQ ID NO: 47203 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 47204 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctgccctttgtacttag

SEQ ID NO: 47205 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaatgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 47206 - DNA, 410 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatcgcccacgaatattggtggcaagcaggcgctggagacggtgcaggcgctgttgccggtgctgtgccaccacgccttcagcgaccaccagtggctggaccacgccgtgggcctcgtcttccactccttcctcctcgtcccttacttctcctggaagtacagtcatcgacgccaccattccaacactggctccctcgagagagacgaagtgtttgtccccaagaagaaggcagacatcaagtggtacggcaagtacctcaacaaccctttgggacgcaccgtgatgttaacggttcaggtcactctcggctggcctttgtacttag

SEQ ID NO: 47207 - DNA, 359 bp, Artificial
  Mutation in BnaA.FAD2.a introduced by TALE nuclease pair BnFAD2_T05
cctctcctcccgcaccctctctcctacttcgcctgtactctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgggagggtaacggggcaggtcactcccggcggcccttgttacttag

SEQ ID NO: 47208 - DNA, 354 bp, Artificial
  Mutation in BnaA.FAD2.a introduced by TALE nuclease pair BnFAD2_T05
ctctcctccctcaccctctctcctacttcgcctggcctctctactgggcctgccaagggtgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47209 - DNA, 355 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccgtttgggacgcaccgtgatgttaacggttcaggtcactctcggctggccttagtgcttag

SEQ ID NO: 47210 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47211 - DNA, 287 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47212 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtgcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47213 - DNA, 450 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgtgcggctgttgccggtgctgtgccaggcccacggcttgaccccccgctccggggtctggccatcgccagccacgatggcggcaacagccgctggacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctgggtacttag

SEQ ID NO: 47214 - DNA, 352 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgcctttagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctagcctggcctttgtacttag

SEQ ID NO: 47215 - DNA, 359 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47216 - DNA, 447 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctcacgggcctctgggtcatcgcccacgaatgctgcttgccaccattattgctggcgatggccaccacctgctggggggtcaagccgtgggcctggcccagcaccgccaccagccgctggaccaccacgccttcagcgaccaccagtggctggacgacgccgtaggcctcgtcttccactccttcctcctcgtccctcacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47217 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 47218 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttatcggttcaggtctctctcggctgccctttgtacttag

SEQ ID NO: 47219 - DNA, 371 bp, Artificial
  Mutation in BnaA.FAD2.a introduced by TALE nuclease pair BnFAD2_T05
cctctcctccctcaccctctctcctacttcgcctggcctctgtactgggcctgccagggctgcgtcctaaccggcgtctgggtcatagcccacgcctgcttgccaccgccatcaccacgccttcagcgactaccagtggctggacgacaccgtccgcctcatcttccactccttcctcctcgtcccttacttctcctggaagtacagtcatcgactccaccattccaacactggctccctcgagagagacgaagtgtttgtccccaagaagaaggcagacatcaagtggtacggcaagtaccgcaacaaccctttggagcgcaccgtgatgttaacggtacaggtctctgttgtctggaatttgtgcttag

SEQ ID NO: 47220 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcaaacatcaagtggtacggcaagtacctcaacaacccttggggacgcaccgtgatgttaacggttcagttcactctcgcctgccctttgtacttag

SEQ ID NO: 47221 - DNA, 356 bp, Artificial
  Mutation in BnaA.FAD2.a introduced by TALE nuclease pair BnFAD2_T05
cctctcctccctcaccctctcccttacctctcctggcccctctactgggcctgccaaggctgcgtcctaacgggcctctgggtcatctcccactagccaccacgccttcagcgcctaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 47222 - DNA, 390 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgttatgttaacggttcaggtcactctcggctggcctttgtacttag

SEQ ID NO: 47223 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 47224 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 47225 - DNA, 385 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccaccacctgctccgccgctggaccgtctccgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47226 - DNA, 353 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcccttagtacttag

SEQ ID NO: 47227 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 47228 - DNA, 358 bp, Artificial
  Mutation in BnaA.FAD2.a introduced by TALE nuclease pair BnFAD2_T05
cctctcctccctcaccctccctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactttcggctgccctttgtacttag

SEQ ID NO: 47229 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcccttagtgcttag

SEQ ID NO: 47230 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47231 - DNA, 355 bp, Artificial
  Mutation in BnaA.FAD2.a introduced by TALE nuclease pair BnFAD2_T05
cctctcctccctcaccctctctcctacttcgcctggcctctctactgagcctgccagggctgcgccccaaccggcgcctgggccatagcccacgagtgccacgccttcagcgactaccagtggctagacgacaccgtcggcctcatcttccactccttcctcctcgtcccttacttctcctggaagtacagtcatcgacgcctccataccaacactggctccctcgagagagacgaagtgtttgtccccaagaagaagccacacatcaagtcgtacggcaagtacctcagcatccgttctggacggcgcgtgaggttaacggttcagttccgtcccggctggcctttgtacttag

SEQ ID NO: 47232 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 47233 - DNA, 333 bp, Artificial
  Mutation in BnaA.FAD2.a introduced by TALE nuclease pair BnFAD2_T05
cctctcctccctcaccctctctcctacttcgcctggcctctctactgggcctgagcaggttattgctggggggtcaccacgccttcagcgactaccagtggctggacgacaccgtctgcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcaggtcactcgcggctgccctttgtacttag

SEQ ID NO: 47234 - DNA, 394 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgatggccaccacctgctggggggtcaagccgtgggccttgaccccgtcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47235 - DNA, 356 bp, Artificial
  Mutation in BnaA.FAD2.a introduced by TALE nuclease pair BnFAD2_T05
cctctcctccctcaccctctctcctacttcgcctgtcctctctactgggcctgccaagggtgcgtcctaaccggcgtctgggtcatagcccacgagtgcacacgccttcagcgattaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47236 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47237 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgcgcctctgggtcatcgcccacgaatgccaccacgccttcagcgcccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccggtgggacgctccgtgatgttaacggttcagttcactctcggctggcctttgtacttag

SEQ ID NO: 47238 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtccaaacgggcctctgggtcatagcccacgagtgcaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgtaccgggatgttaacggttcagttcactctcggctggcctttgtacttag

SEQ ID NO: 47239 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcggcccttggtacttag

SEQ ID NO: 47240 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagggtttgcccccaagaagaaggcagacatcaagtggtacggcaagtacctcaacaaccctctgggacgccccgggatgttatcggtgcaggtcacttgcgcctggcctttgtacgtag

SEQ ID NO: 47241 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccatggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaaaacccctttgggacgcaacgtgatgttaacggttccgttcactctcggctggcctttgtacttag

SEQ ID NO: 47242 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47243 - DNA, 460 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgatgttacgcagcagggcagtcgccctaaaacaaagttaaacattatgagggaagcggtgatcgccgaagtatcgactcaactatcagaggtagttggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaagccgacatcaagtggtacggcaagtacctcaacaaccctttgggacgcaccgtgatgttaacggttcatgtcactctcgcctggcctttgtacttag

SEQ ID NO: 47244 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47245 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggtacagttcactctcggctggccttaatacttag

SEQ ID NO: 47246 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcgctctcggctggcctttgtacttag

SEQ ID NO: 47247 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47248 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccgccaccacgccttcagcgactaccagtggctggacgacaccgtcggcctcatcttccactccttcctcctcgtcccttacttctcctggaagtacagtcatcgacgccaccattccaacactgtctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47249 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactcgcggctggcctttgtacttag

SEQ ID NO: 47250 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcgccaccacgccttcagcgactaccagtggctggacgacaccgtcggcctcatcttccactccttcctcctcgtcccttacttatcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47251 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacaacaagtggtacggcaagtacctcaacaaccctttgagacgcaccgtgatgttaacggttcagttcactctcggctggccttttacttag

SEQ ID NO: 47252 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47253 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgcgggacgcaccgtgatgttaacggttcagttcactctcggctgccctttgtacttag

SEQ ID NO: 47254 - DNA, 371 bp, Artificial
  Mutation in BnaA.FAD2.a introduced by TALE nuclease pair BnFAD2_T05
cctctcctccctcaccctctctcctacttcgcctggcccctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgttggacgcaccgtgatgttaacggttcagttcactcgcggctggcctttgtacttag

SEQ ID NO: 47255 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaccagccgctggacaacgccttcagcgactaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcattcgtacttag

SEQ ID NO: 47256 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47257 - DNA, 358 bp, Artificial
  Mutation in BnaA.FAD2.a introduced by TALE nuclease pair BnFAD2_T05
cctctcctccctcaccctctcccttacctcggctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47258 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47259 - DNA, 352 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 47260 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47261 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47262 - DNA, 444 bp, Artificial
  Mutation in BnaA.FAD2.a introduced by TALE nuclease pair BnFAD2_T05
cctctcctccctcaccctctctcctacttcgcctggcctatctactgggcctgccagggctgcgtcctaaccgccgtctgggtcatagcccacgagtgcggccagatcaatgtcgatcgtggctggctcgaagatacctgcaagagtctcatattcactctcaatccaaataatctgcaccggatcaccacgccttcagcgactaccagtggctggacgacaccgtcggcctcatcttccactccttcctcctcgtcccttacttctcctggaagtacagtcatcgacgccacctgtccaacactggctccctcgagagagacgaagtgtttgtccccaagaagaagtcagacatcaagtggtacggcaaggacctcaacaaccctctggtacgcaccgggatgttaacggttcatgtcactcgcgggtgccctgtgtacttag

SEQ ID NO: 47263 - DNA, 435 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47264 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatggtaacggttcaggtcactctcggctgccctttgtgcttag

SEQ ID NO: 47265 - DNA, 356 bp, Artificial
  Mutation in BnaA.FAD2.a introduced by TALE nuclease pair BnFAD2_T05
cctctcctccctcaccctctcacctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47266 - DNA, 390 bp, Artificial
  Mutation in BnaA.FAD2.a introduced by TALE nuclease pair BnFAD2_T05
cctctcctccctcaccctctcccgtacctcgcctggcccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47267 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatcgcccacggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 47268 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctgtgtacttag

SEQ ID NO: 47269 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgccaccacgcctgcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgggatgttaacggtgcagttcactctcggctggcctttgtacttag

SEQ ID NO: 47270 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctcccgcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47271 - DNA, 465 bp, Artificial
  Mutation in BnaA.FAD2.a introduced by TALE nuclease pair BnFAD2_T05
cctctcctccctcaccctctaccttacctcgcctggcccctctactgggcctgccaaggctgcgtcctaacgggcctctgggtcatcgcccacgaatgcggcccatcgccagcaatattggtggcaagcaggcgctggagacggtgccaggcccacggcttgaccccggagcaggtggtggccatcgccagcaatattggtggcaagcaggaaccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47272 - DNA, 358 bp, Artificial
  Mutation in BnaA.FAD2.a introduced by TALE nuclease pair BnFAD2_T05
cctctcctccctcaccctgtctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47273 - DNA, 356 bp, Artificial
  Mutation in BnaA.FAD2.a introduced by TALE nuclease pair BnFAD2_T05
cctctcctccctcaccctctctcctacttcgcctggcctctctactgggcctgcccgggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47274 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47275 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgctctctcggctggcctttgtacttag

SEQ ID NO: 47276 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaaccacgccttcagcgactaccagtggctggacgacaccgtcggcctcatcttccactccttcctcctcgtcccttacttctcctggaagtacagtcatcgacgccaccattcaaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47277 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47278 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47279 - DNA, 360 bp, Artificial
  Mutation in BnaA.FAD2.a introduced by TALE nuclease pair BnFAD2_T05
cctctcctccctcaccctctctcctacttcgtctggcctaccttctgggccagccaagcgtgcgccctaaacagcgtctgggtcctcgcccacgagtgtgccaccaagacttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaagccttaggtacgcacaggaatgtgacccgtccagctcactctcggctggcctttgtacttag

SEQ ID NO: 47280 - DNA, 443 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47281 - DNA, 342 bp, Artificial
  Mutation in BnaA.FAD2.a introduced by TALE nuclease pair BnFAD2_T05
cctctcctccctcaccctctctgctacttcgcctggcctctctcctgagcctgccagggctgcgtcctaacgagcgtctgggtcaccacgccttcagcgactaccagtggctggacgacaccgtcggcctcatcttccactccttcctcctcgtcccttacttctcctggaagtacagtcatcgacgccaccattccaacaccggctccctcgagagagacgaagtgtttgtccccaagaagaagtcagacatcaagtggtacgtcaattacccgaacgcccctgagggacgcaacgtgctgctaacgcttccgttccctctcggctggcctttgtacttag

SEQ ID NO: 47282 - DNA, 446 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcggctgttgccggtgctgcgccaggcccccggcttgaccacggcttgaccccccagcaggtggtggccatcgccagcaatattggtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47283 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcatccccaagaagaaatccgacatcaagtggtacggaaagtacctcaacaaccctttgggacgcaccgtgatgttaacggttcagttcactctcggctggcctttgtacttag

SEQ ID NO: 47284 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47285 - DNA, 329 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47286 - DNA, 340 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47287 - DNA, 394 bp, Artificial
  Mutation in BnaA.FAD2.a introduced by TALE nuclease pair BnFAD2_T05
cctctcctccctcaccctctctcctacttcgcctagcctctctactgggcctgccagggctgcgtcctcaccggcgtctgggtcatagcccacgagtgcgatggccaccacctgctggtgggtcaagccgtgggccttgaccccgtcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47288 - DNA, 358 bp, Artificial
  Mutation in BnaA.FAD2.a introduced by TALE nuclease pair BnFAD2_T05
cctctcctccctcaccctctgtcctacttcgcctggcctctcctctgagcctgccagggctgcgccctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtgcctcagcaaccgtttgagacgcaccgtggagttaacggttcagttcactctcggctggcctttgtacttag

SEQ ID NO: 47289 - DNA, 356 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47290 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccatggctgcgtcctaaccggcgtctgggtcatagcccacgcgtgccaccacgccttcagctaccaccagtggctggacgacgccgccggcctcgtcttccactccttcctcctcgtcccgtacttctcctggaagtacagtcatcgacgccaccattccaacactggctccctcgagagagacgaagtgtttgtccccaagaagaagtcagacatcaagtggtacgtcaattatcgcagcaagcctcagggacgcatagtggtgttaccggttcccttcactctcggctggcctttgtacttag

SEQ ID NO: 47291 - DNA, 358 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47292 - DNA, 446 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcggctgttgccggtgctgtgccaggcccacggcttgaccacggcttgaccccccagcaggtgggggccatcgccagcaatattggtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47293 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtaccccaacaacccgctaggacgcacggtgatgctaaccgtccagttcccgctcggctggcctttgtacttag

SEQ ID NO: 47294 - DNA, 356 bp, Artificial
  Mutation in BnaA.FAD2.a introduced by TALE nuclease pair BnFAD2_T05
cctctcctccctcaccctatctcctacttcgcctggcctctctactgggcctgccaagggtgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47295 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47296 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggttccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47297 - DNA, 362 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagggtttgtccccaagaagaagtcagacatcaagtggtacggcaagtacctcaacaacctgttgggacgcaccgtgatgttaacggtgcaggtcactcgtggctggcctttgtacttag

SEQ ID NO: 47298 - DNA, 358 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47299 - DNA, 340 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtgctacaagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttctctctcggctggcctttgtacttag

SEQ ID NO: 47300 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47301 - DNA, 410 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatattggtggcaagcaggcgctggagacggtgcaggcgctgttgccggtgctgtgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 47302 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgtgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47303 - DNA, 346 bp, Artificial
  Mutation in BnaA.FAD2.a introduced by TALE nuclease pair BnFAD2_T05
cctctcctccctcaccctctcccttacctcgcctggcccctctactgggcctgccaaggctgcgccctaacgggcctctgggtcatctaccacgccttcagcgcccaccagtggctggacgacgccgtgggcctcgtcttccactccttcctcctcgtccctttcttctcctggaagtacagtcatcgacgccaccattccaacactggctccctcgagagagacgaagtgtttgtcccccagaagaagtcagacatcaagtggtccggcaagtacctcaccaaccctttgggacgcaccgtgatgttaacggttcagttcacgctcggctggccttagtacttag

SEQ ID NO: 47304 - DNA, 346 bp, Artificial
  Mutation in BnaA.FAD2.a introduced by TALE nuclease pair BnFAD2_T05
cctctcctccctcaccctctccattacctcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47305 - DNA, 362 bp, Artificial
  Mutation in BnaA.FAD2.a introduced by TALE nuclease pair BnFAD2_T05
cctctcctccctcaccctctctcctgcttctcctgccttctttcctgtatatgcatctcctaccccctaacccgcgtctgagtcatagcccccgagttctgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47306 - DNA, 351 bp, Artificial
  Mutation in BnaA.FAD2.a introduced by TALE nuclease pair BnFAD2_T05
cctctcctccctcaccctctctactacttcgcctggcctctctactgggcctgccagggctgcgtcctaaccggcgtctgggtcatagcccacgagtcgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47307 - DNA, 424 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 47308 - DNA, 444 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagatcaatgtcgatcgcggctggctcgaagatacctgcaagagtctcatattcactctcaatccaaataatctgcaccggatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactcgcggctggcctttgtacttag

SEQ ID NO: 47309 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagggatgaagtgtttgtcccaaagaagaaatccgacatcaagtggtacggaaagtacctcaacaacccgctaggacgcacggtgatgctaaccgtccagttcacgcgcggctggcctttgtacttag

SEQ ID NO: 47310 - DNA, 362 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47311 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47312 - DNA, 283 bp, Artificial
  Mutation in BnaA.FAD2.a introduced by TALE nuclease pair BnFAD2_T05
cctctcctccctcaccctctaccttaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47313 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47314 - DNA, 353 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggctcagttcactctcggctggcctttgtacttag

SEQ ID NO: 47315 - DNA, 353 bp, Artificial
  Mutation in BnaA.FAD2.a introduced by TALE nuclease pair BnFAD2_T05
cctctcctccctcaccctctccattacctcgcctggcccctctactgggcctgccaaggctgcgtcctaacgggcctctgggtcatcgcccacgcaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47316 - DNA, 394 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcattgctcatcaatttgttgcaacgaacaggtcactatccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 47317 - DNA, 363 bp, Artificial
  Mutation in BnaA.FAD2.a introduced by TALE nuclease pair BnFAD2_T05
cctctcctccctcaccctctctcctacttcgcctggcctctctaatgggcctgccagggctgcgtcctaaccggcgtctgggtcatagcccacgagtgccccgccaccacgccttcagcgactaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47318 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47319 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatcgcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 47320 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47321 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgccaccacgccttcagcgaccaccagtggctggacgacgccgtaggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47322 - DNA, 358 bp, Artificial
  Mutation in BnaA.FAD2.a introduced by TALE nuclease pair BnFAD2_T05
cctctcctccctcaccctctcccttacctcgcctggccactctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47323 - DNA, 471 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcttggcgatggcaagcaggcgctggagacggtccagcggctgttgccggtgctgtgccaggcccacggcttgaccccccagcaggtggtggccatcgccagcaataatggtggcaagcaggcgccaccacgccttcagcgactaccagtggcttgacaacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47324 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47325 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47326 - DNA, 371 bp, Artificial
  Mutation in BnaA.FAD2.a introduced by TALE nuclease pair BnFAD2_T05
cctctcctccctcaccctatcccttacctcgcctggcccctctactgggcctgccagggctgcgtcctaaccggcgtctgggtcatagcccacgcctgctttccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47327 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgtcaacggttcatttcactctcggctggcctttgtacttag

SEQ ID NO: 47328 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccatcgagagagacgaagtgtttgtccccaagaagaagtcagacatcaagtggtacggcaagtacctcaacaaccctttggtacgcaccgtgatgtcaacggttcagttccctctcggctggcctttgtacttag

SEQ ID NO: 47329 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 47330 - DNA, 360 bp, Artificial
  Mutation in BnaA.FAD2.a introduced by TALE nuclease pair BnFAD2_T05
cctctcctccctcaccctctctcctacttcgcctagcctctctaataagcctgccagggctgcgtcctaaccggcgtctgtgtcatagcccacgagtgcgccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctctgctggccgtggtacttag

SEQ ID NO: 47331 - DNA, 358 bp, Artificial
  Mutation in BnaA.FAD2.a introduced by TALE nuclease pair BnFAD2_T05
cctctcctccctcaccctctctcctacttcgcctggactctctcctgggcctgccagggctgcgtcctaaccggcgtctgggtcatcgcccacgagtgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggccttagtacttag

SEQ ID NO: 47332 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacaggcgtctgggtcatagcccaccacgccttcagcgactaccagtgactggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47333 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacaccgtcggtctcatcttccactccttcctcctcgtcccttacttctcctggaagtacagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47334 - DNA, 357 bp, Artificial
  Mutation in BnaA.FAD2.a introduced by TALE nuclease pair BnFAD2_T05
cctctcctccctcaccctctctcctacttcgcctggcctctctaatgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 47335 - DNA, 394 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcgatggccaccacctgctggggggtcaagccgtgggccttgaccccgtcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47336 - DNA, 419 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatcgcccacgagtgcggccagcggtacgcgtactacttgcgttgcgctcactgcccgcaaaaggccagccacaggcccccccgccttcagcgactgccagtggctggacgacaccgtcggcctcatcttccactccttcctcctcgtcccttacttctcctggaagtacagtcatcgacgccaccagtccaacactggctccctcgagagggatgaagtgttcgtccccaagaagaaatccgacatcaagtggtacggaaagtacctcaacaaccctctgggacgcacggtgatgttaaccgtccagttcacgctcggctggcctttgtacttag

SEQ ID NO: 47337 - DNA, 345 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcacgctcggctggcctttgtacttag

SEQ ID NO: 47338 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaaatccgacatcaagtggtacggaaagtacctcaacaacccgctaggacgcacggtgatgctaaccgtccaggtcacgcgcggctggcctttgtacttag

SEQ ID NO: 47339 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47340 - DNA, 356 bp, Artificial
  Mutation in BnaA.FAD2.a introduced by TALE nuclease pair BnFAD2_T05
cctctcctccctcaccatctctcctacttcgcctggcctctctactgggcctgccagggctgcgtcctaaccggcgtctgggtcatagcccacgagccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47341 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47342 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 47343 - DNA, 358 bp, Artificial
  Mutation in BnaA.FAD2.a introduced by TALE nuclease pair BnFAD2_T05
cctctcctccctcaccctctcccttacctcgcctggaccctctactgggcctgccaaggctgcgtcctcacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47344 - DNA, 353 bp, Artificial
  Mutation in BnaA.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47345 - DNA, 350 bp, Artificial
  Mutation in BnaA.FAD2.a introduced by TALE nuclease pair BnFAD2_T05
cctctcctccctcaccctctatcctacttcgcctggcctctctcctgggcctgccagggctgcgtcctaaccggcgtctgggtcatagccctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtggtgtgaacggttcaggtcactctcggctggccttagcacttag

SEQ ID NO: 47346 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 47347 - DNA, 430 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaggcccacggcaacagccgctggaccgtctccagcgcctgcttgccaccattattgctggcgatggccacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47348 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 47349 - DNA, 432 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47350 - DNA, 333 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatcgcccacgaatgtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47351 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47352 - DNA, 439 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccattgctggcgatggccaccacctgctccggggtcaagccgtgggcctggcacagcaccggcaagcaggcgctggagagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 47353 - DNA, 360 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47354 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgaccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 47355 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47356 - DNA, 358 bp, Artificial
  Mutation in BnaA.FAD2.a introduced by TALE nuclease pair BnFAD2_T05
cctctcctccctcaccctctctcctacttcgcctggcctcactactgggcctgccagggctgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47357 - DNA, 363 bp, Artificial
  Mutation in BnaA.FAD2.a introduced by TALE nuclease pair BnFAD2_T05
cctctcctccctcaccatctctcctacttcgcctggcctctctactgggcctgccagggctgcgtcctaaccggcgtctgggtcatagcccacgagtgcccagccaccactccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47358 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 47359 - DNA, 349 bp, Artificial
  Mutation in BnaA.FAD2.a introduced by TALE nuclease pair BnFAD2_T05
cctctcctccctcaccctctcggctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47360 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatcgcccacgaatgaaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47361 - DNA, 356 bp, Artificial
  Mutation in BnaA.FAD2.a introduced by TALE nuclease pair BnFAD2_T05
cctctcctccctcaccatctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47362 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacagttcagttcactctcggctggcctttgtacttag

SEQ ID NO: 47363 - DNA, 424 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacctgcgtctgggtcatagcccacgagtgcggtatcagaggtagttggcgtcatcgagcgccatctcgaaccgacgttgctggccgtacatttgtacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctgtgggacgcgccgtgttgttaacggttcagttcactctcggctgtccgttgtacttag

SEQ ID NO: 47364 - DNA, 358 bp, Artificial
  Mutation in BnaA.FAD2.a introduced by TALE nuclease pair BnFAD2_T05
cctctcctccctcaccctctctcctacttcgcctggctcctctactcggcctgccaaggctgcgccctaacgagcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacgcctctgttggacgcaccatgattttaacggttcagttcactctcggctggcctttgtacttag

SEQ ID NO: 47365 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaaccggcgtctgggtcatagcccacgagtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47366 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtccgttgtacgtag

SEQ ID NO: 47367 - DNA, 359 bp, Artificial
  Mutation in BnaA.FAD2.a introduced by TALE nuclease pair BnFAD2_T05
cctctcctccctcaccctctcccttacctcacctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47368 - DNA, 446 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcggctgttgccggtgctgtgccaggcccacggcttgaccacggcttgaccccggagcaggtggtggccatcgccagcaatattggtcaccacgccttcagcgactaccagtggctggacgacaccgtcggcctcatcttccactccttcctcctcgtcccttacttctcctggaagtacagtcatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47369 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 47370 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgcctttagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47371 - DNA, 402 bp, Artificial
  Mutation in BnaA.FAD2.a introduced by TALE nuclease pair BnFAD2_T05
cctctcctccctcaccctctcccttacctcgcctggcacctctactgggcctgccagggctgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 47372 - DNA, 333 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacataaagtggtacggcaagtacctcaacaaccctttgggacgcaccgtgatgttaacggttcagttcactctcggctggcctttgtacttag

SEQ ID NO: 47373 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcatcttcaactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47374 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatcgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcatgtacctcaacaaccctttgggacgtaaggtgatgttaacggttcagttcactctcggctggcctttgtacttag

SEQ ID NO: 47375 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcaccccgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47376 - DNA, 435 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47377 - DNA, 356 bp, Artificial
  Mutation in BnaA.FAD2.a introduced by TALE nuclease pair BnFAD2_T05
cctctcctccctcaccttctcccttacctcgcctggcccctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47378 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47379 - DNA, 345 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47380 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47381 - DNA, 435 bp, Artificial
  Mutation in BnaA.FAD2.a introduced by TALE nuclease pair BnFAD2_T05
cctctcctccctcaccctctcccttacctcgcctggccactctactgggcctgccaaggctgcgtcctaacgggcctctgggtcattgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 47382 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttttccccaagaagaagtcagacatcaagtggtacggcaagtacctcaacaaccctttgggacgcaccgtgatgttaacggttcagttcactctcggctggcctttgtacttag

SEQ ID NO: 47383 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgtaaacggttcagttcactctcggctggcctttgtacttag

SEQ ID NO: 47384 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcaggtcacgctcggctggcctttgtacttag

SEQ ID NO: 47385 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47386 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 47387 - DNA, 363 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47388 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcacgctcggctggcctttgtgcttag

SEQ ID NO: 47389 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47390 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47391 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccaagggtacgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47392 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47393 - DNA, 362 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaactacctcaacaacccgctaggacgcacggtgatgctaaccgtccagttcacgctcggctgccctttgtacttag

SEQ ID NO: 47394 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47395 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtccggcaagtacctcaacaaccctttgggacgcaccgtgatgttaacggttcagttcactctcggctggcctttgtacttag

SEQ ID NO: 47396 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 47397 - DNA, 364 bp, Artificial
  Mutation in BnaA.FAD2.a introduced by TALE nuclease pair BnFAD2_T05
cctctcctccctcaccctctctcctacttcgcctggccactctactgggcctgccagggctgcgtcctaaccggcgtctgggtcatagcccacgagtgcggccccaacacgccttcagcgaataacaggggctgggcgacaccctcggcctcatcttcctctccttcctcctcgtcccttacttctcctggaagtacagtcatcggcgccaccattccaacacgggctccctcgagagagacgaagtgtttgtccccaagaagaagtcagacatcaagtggtacggcaagttcctcgacagccccttatgacgatacgtgagggtaacgcttccgttcccccctcggctggccttggtacttag

SEQ ID NO: 47398 - DNA, 362 bp, Artificial
  Mutation in BnaA.FAD2.a introduced by TALE nuclease pair BnFAD2_T05
cctctcctccctcaccctctctcctacttctcctggcctctctactgggcctgccagggctgcgtcctaaccggcgtctgggtcatagcccacgagtgcggtccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagccatcaagtggtacggcaagtacctcaacaccccattgggacgcaccgtgatgttaacggttgagttcactctcggctggcatgtatacttag

SEQ ID NO: 47399 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtactag

SEQ ID NO: 47400 - DNA, 350 bp, Artificial
  Mutation in BnaA.FAD2.a introduced by TALE nuclease pair BnFAD2_T05
cctctcctccatcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtccattacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47401 - DNA, 411 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaccacctgctggggggtcaagccgtggggtcaagccgtgggcctggcccagcaccggcaacagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcacgctcggctggcctttgtacttag

SEQ ID NO: 47402 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctccgggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47403 - DNA, 351 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtcttag

SEQ ID NO: 47404 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47405 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47406 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggatggcctttgtacttag

SEQ ID NO: 47407 - DNA, 353 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47408 - DNA, 409 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggtggcaagcaggcgctggagacggtccagcgcctgcttgccgccatcgcctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47409 - DNA, 355 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47410 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47411 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagtcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47412 - DNA, 357 bp, Artificial
  Mutation in BnaA.FAD2.a introduced by TALE nuclease pair BnFAD2_T05
cctctcctccctcaccctctcacttacctcgcctggcccctctactgggcctgccaaggctgcgtcctaacgggcctctgggtcatcgcccacgagtgcaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaaggagaagtcagacatcaagtggtacgggaagtacctcaacaaccccttgggacgcaccgtgatgttaacgtttcagttcactctcggctggcctgtgtacttag

SEQ ID NO: 47413 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47414 - DNA, 328 bp, Artificial
  Mutation in BnaA.FAD2.a introduced by TALE nuclease pair BnFAD2_T05
cctctcctccctcaccctctctcctacttcgcctggcctctctactgagcctgccagggctgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagggatgaagtgttcgtccccaagaagacatccgacatcaagtggtacggaaagtacctcaacaacccgctaggacgcacggtgatgctaaccgtccagtgtacgctcggctggcctttgtacttag

SEQ ID NO: 47415 - DNA, 329 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatcgcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacaacccgttgggacgcaccgtgatgttaacggttcagttcactctcggctggccatagtacttag

SEQ ID NO: 47416 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctggatcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47417 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgaccaccagtggctggacgacaccgtcggcctcatcttccactccttcctcctcgtcccttacttctcctggaagtacagtcatcgacgccaccattccaacactggatccctcgagaggtatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47418 - DNA, 356 bp, Artificial
  Mutation in BnaA.FAD2.a introduced by TALE nuclease pair BnFAD2_T05
cctctcctccctcaccctctctcctacttcgcctggcctctctactgggcctaccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47419 - DNA, 449 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcagggattttggtcatgggtggctcgagggttatttgccgactaccttggtgatctcgcctttcacgtagtggacaaattcttccaactggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagtgcacgctcggctggcctttgtacttag

SEQ ID NO: 47420 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 47421 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47422 - DNA, 319 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47423 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcactctcggctggcctttgtacttag

SEQ ID NO: 47424 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47425 - DNA, 446 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcggctgttgccggtgctgtgccaggcccacggcttgaccacggcttgaccccccagcaggtggtggccatcgccagcaatattggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47426 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcttttgtacttag

SEQ ID NO: 47427 - DNA, 345 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47428 - DNA, 333 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 47429 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctactcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47430 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaattcagacatcaagtggtacggcaagtacctcaacaaccctttgggacgcaccgtgatgttaacggttcagttcactctcggctggcctttgtacttag

SEQ ID NO: 47431 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47432 - DNA, 447 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggctagccacgatggcggctagccacggtggtggccatcgccagccacgatggcggcaagcaggcgctggagcctggcacagcaccggccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47433 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 47434 - DNA, 439 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccattgctggcgatggccaccacctgccccggggtcaagccgtgggcctggcacagcaccggcaagcaggcgctggagagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccttggtacgtag

SEQ ID NO: 47435 - DNA, 471 bp, Artificial
  Mutation in BnaA.FAD2.a introduced by TALE nuclease pair BnFAD2_T05
cctctcctccctcaccctctctcctacttcgcctcgcctctctactgggcctgccagggctgcgtcctaaccggcgtctgggtcatagcttggcgatggcaagcaggcgctggagacggtccagcggctgttgccggtgctgtgccaggcccaccgcttgaccccccagcaggtggtggccatcgcccgcaataatggtggcaagcaggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47436 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtcttggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47437 - DNA, 358 bp, Artificial
  Mutation in BnaA.FAD2.a introduced by TALE nuclease pair BnFAD2_T05
cctctcctccctcaccctctctcctacttcgcctggcctctctactgggcccgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtttactctcggctggcctttgtacttag

SEQ ID NO: 47438 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctttacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47439 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 47440 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 47441 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccaggactgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtaccgcaacaacccgctaggacgcacggtgatgctaaccggccagttcacgctcggctggcctttggacttag

SEQ ID NO: 47442 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47443 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47444 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 47445 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 47446 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccacccttccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47447 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47448 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtgccccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47449 - DNA, 287 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47450 - DNA, 333 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatcgcccacgaatgtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47451 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccgcttgggacgcacagtgatgttaacgtttcagttcactctcggctggccgttgtacttag

SEQ ID NO: 47452 - DNA, 350 bp, Artificial
  Mutation in BnaA.FAD2.a introduced by TALE nuclease pair BnFAD2_T05
cctctcctccctcaccctctctcctacttcgcatggcctctctactgggcctgccagggctgcgtcctaaccggcgtctgggtcatagcccacgagtgcggccagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47453 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcaccgtgatgttaactgttcagttcactctcggctggcctttgtacttag

SEQ ID NO: 47454 - DNA, 362 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47455 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagccccgtcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggaagcaccgtgatgttaacggttcagttcactcgtggctggcctttgtacgtag

SEQ ID NO: 47456 - DNA, 447 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggctagccacgatggcggctagccacggtggtggccatcgccagccacgatggcggccagcaggcgctggagcctggcacagcaccggccaccacgccttcagcgactaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 47457 - DNA, 358 bp, Artificial
  Mutation in BnaA.FAD2.a introduced by TALE nuclease pair BnFAD2_T05
cctctcctccctcaccctctctcctacttcgcctggcctctctacttggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47458 - DNA, 350 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47459 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47460 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 47461 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatatcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47462 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47463 - DNA, 361 bp, Artificial
  Mutation in BnaA.FAD2.a introduced by TALE nuclease pair BnFAD2_T05
cctctctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47464 - DNA, 362 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgccggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47465 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47466 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagccaccacgccttcagcgactaccagtggctggacgacaccgtcggcctcatcttccactccttcatcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47467 - DNA, 356 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47468 - DNA, 480 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggcaggcgctggagacggtccagcggctgttgccggtgctgtgccaggcccacggcttgaccccccagcaggtggtggccatcgccagcaataatggtggcaagcaggcgctggagacggtccagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47469 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaccccttttggacgcacggtgatgttaacggttcagttcactctcggctggcctttgtacttag

SEQ ID NO: 47470 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgctaccacgccttcagcgactaccagtggctggacgacaccgtcagcctcattttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggactcaccgtgatgttaacggatcagttctctctcggctggccgtggtacttag

SEQ ID NO: 47471 - DNA, 463 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctgcgttaagccaacacccggcagcgttagggaccgtcgctgtcaagtatcaggacattttttctgcgcgtaatctgctgcttgcaaacaaaaaaaccaccgctggaaccacgccttcagcgactaccagttgctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47472 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacgacaagtacctcaacaaccctttgggacgcaccgtgatgttaacggttcagttcactctcggctggcctttgtacttag

SEQ ID NO: 47473 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47474 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 47475 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 47476 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47477 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtctgtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47478 - DNA, 346 bp, Artificial
  Mutation in BnaA.FAD2.a introduced by TALE nuclease pair BnFAD2_T05
cctctcctccctcaccctctcccttacctcgcctggccactctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacagccctgtgggacgcaccgtgatgttaacggttcagttcacgctcggctggcctttgtacttag

SEQ ID NO: 47479 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaactctttgggacgcaccgtgatgttaacggttcagttcactctcggctggcctttgtacttag

SEQ ID NO: 47480 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47481 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcaaccacgccttcagcgactaccagtggctgggcgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47482 - DNA, 346 bp, Artificial
  Mutation in BnaA.FAD2.a introduced by TALE nuclease pair BnFAD2_T05
cctctcctccctcaccctctctcttacctcgcctgtcccctctactgggcctgccaaggctgcgccctaaccggcctctgggtcatataccacgccttcagccaccaccagtggctggacgacaccgtccgcctcaacttccactccttcctcctcgtcccttacttctcctggaagtacagtcatcgacgccaccattccaacactggctccctcgagagagacgaagtgtttgtccccaagaagaagtcagacatcaagtggtacggcgagtacctcaacaaccgtttggaacgcaccgtgatgttaaccgttcagttccctctcggctggcctttgtacttag

SEQ ID NO: 47483 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggactacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47484 - DNA, 328 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47485 - DNA, 419 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccagcggtacgcgtattaattgcgttgcgctcactgcccgcaaaaggccagcaaaaggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47486 - DNA, 358 bp, Artificial
  Mutation in BnaA.FAD2.a introduced by TALE nuclease pair BnFAD2_T05
cctctcttccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47487 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 47488 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacgaccctttgggacgcaccgtgatgttaacggttcagttcactctcggctggcctttgtacttag

SEQ ID NO: 47489 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaataagtcagacatcaagtggtacggcaagtacctcaacaaccctttgggacgcaccgtgatgttaacggttcagttcactctcggctggcctttgtacttag

SEQ ID NO: 47490 - DNA, 353 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47491 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47492 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggtctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47493 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47494 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47495 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggctggacgacaccgtcggcctcatcttccactccttcctcctcgtcccttacttctcctggaagtacagtcatcgacgccaccattccaacactggctccctctagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47496 - DNA, 463 bp, Artificial
  Mutation in BnaA.FAD2.a introduced by TALE nuclease pair BnFAD2_T05
cctctcctccctcaccctctctcctacttcgcctggcctctctactgggcctcccagggctgcgtcctaaccggcgtctgggtcatagcccacgagtgctgcgttaagccaacacccggcagcgttagggaccgtcgctgtcaagtatcaggacattttttctgcgcgtaatctgctgcttgcaaacaaaaaaaccaccgctggaaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47497 - DNA, 348 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47498 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 47499 - DNA, 430 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcgcggatggcctttttgcgtttctacaaactcttcctggctagcggtacgcgtattaattgcgttgcgctcgccaccacgccttcagcgactaccagtggctggacgacaccgtcggcctcatcttccactccttcctcctcgtcccttacttctcctggaagtacagtcatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47500 - DNA, 358 bp, Artificial
  Mutation in BnaA.FAD2.a introduced by TALE nuclease pair BnFAD2_T05
cctctcctccctaaccctctctcctacttcgcctggcctctctactgagcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacagccctttgggacgcaccgtgatgttaacggttcagttcactctcggctggccttcgtacttag

SEQ ID NO: 47501 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgtttgtccccaataagaagtcagccatcaagtggtaccgcaactacctcaccacccctttgggacgcactgtgatgttaacggttcacgtcaccctcggctggcctttgtacttag

SEQ ID NO: 47502 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47503 - DNA, 363 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47504 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47505 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcaggcatcaagtggtacggcaagtacctcaacaaccctttgggacgcaccgtgatgttaacggttcagttcactctcggctggcctttgtacttag

SEQ ID NO: 47506 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 47507 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggggatgctaaccgtccagttcacgctcggctggcctttgtacttag

SEQ ID NO: 47508 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtaagacatcaagtggtacggcaagtacctcaacaacccttttggacgcaccgtgatgttaacggttcagttcactctcggctggcctttgtacttag

SEQ ID NO: 47509 - DNA, 383 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47510 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacagcaagtggtacggcaagtacctcaacaaccctttgggacgcaccgtgatgttaacggttaagttcactctcggctggcctttgtacttag

SEQ ID NO: 47511 - DNA, 360 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcaccacgccctcaacgaccaccaggggctggacgacgccgtgggcctcgtcttccactccttcctccccgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47512 - DNA, 430 bp, Artificial
  Mutation in BnaA.FAD2.a introduced by TALE nuclease pair BnFAD2_T05
cctctcctccctcaccctctctcctacttcgcctggcctctctacttggcctgccagggctgcgtcctaaccggcgtctgggtcatagcccacgagtgcgcggatggcctttttgcgtttctacaaactcttcctggctagcggtacgcgtattaattgcgttgcgctcgccaccacgccttcagcgactaccagtggctggacgacaccgtcggcctcatcttccactccttcctcctcgtcccttacttctcctggaagtacaatcatcgacgccaccattccaacactggctccctcgagagagacgaagtgtttgtccccaagaagaagtcagacatcaagtggtacggcaagtacctcaacaaccctttggaacgcaccgtgatgttaacgtttcagttcactctcggctggcctgagtacgtag

SEQ ID NO: 47513 - DNA, 402 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47514 - DNA, 450 bp, Artificial
  Mutation in BnaA.FAD2.a introduced by TALE nuclease pair BnFAD2_T05
catctcctccctcaccctctctcctacttcgcctggcctctctactgggcctgccagggctgcgtcctaaccggcgtctgggtcatagcccacgagcggctgttgccggtgctgtgccaggcccacggcttgaccccccgctccggggtctggccatcgccagccacgatggcggcaacagccgctggacccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47515 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctgtgtacttag

SEQ ID NO: 47516 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 47517 - DNA, 350 bp, Artificial
  Mutation in BnaA.FAD2.a introduced by TALE nuclease pair BnFAD2_T05
cctctcctcccttaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47518 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggccttcgtacttag

SEQ ID NO: 47519 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccgtttgggacgcaccgtgatgttaacggttcagttcactctcggctggcctttgtacttag

SEQ ID NO: 47520 - DNA, 333 bp, Artificial
  Mutation in BnaA.FAD2.a introduced by TALE nuclease pair BnFAD2_T05
cctctcctccctcaccctctctcctacttcgcctggcctctctactaggcctgagcaggttattgctggggggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47521 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggcttcagcgactaccagtggctgggcgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47522 - DNA, 349 bp, Artificial
  Mutation in BnaA.FAD2.a introduced by TALE nuclease pair BnFAD2_T05
cctctcctccctcaccctctctcctacttcgcctggcccctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47523 - DNA, 362 bp, Artificial
  Mutation in BnaA.FAD2.a introduced by TALE nuclease pair BnFAD2_T05
cctctcgtccctcaccctctcccttacctcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 47524 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacataagtggtacggcaagtacctcaacaaccctttgggacgcaccgtgatgttaacggttcagttcactctcggctggcctttgtacttag

SEQ ID NO: 47525 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47526 - DNA, 360 bp, Artificial
  Mutation in BnaA.FAD2.a introduced by TALE nuclease pair BnFAD2_T05
cctctcctccctcaccctctctcctacttcgcctggcctccctactgggcctgccagggctgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 47527 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47528 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47529 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47530 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47531 - DNA, 443 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggccgctcaacttgaccccggagcaggtggtggccatcgccatgcctcctctagaccagccaggccagaaatgcctcgacttcgccaccacgccttcagcgaccaccagtggccggacgacgccgtgggcctcgtcttcccctccttcctcctcgtcccttacttctcctggaagtacagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47532 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcatacatcaagtggtacggcaagtacctcaacaaccctttgggacgcaccgtgatgttaacggttcagttcactctcggctggcctttgtacttag

SEQ ID NO: 47533 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47534 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagctactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47535 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47536 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaaccggcgtctgggtcatagcccacgcaccccgccttcagcgactaccagtgtctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47537 - DNA, 356 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagccatcaagtggtacggcaagtacctcaacaaccctttgggacgccccgtgatgttaacggttcagttcactctcggctggcctgtgtacttag

SEQ ID NO: 47538 - DNA, 424 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47539 - DNA, 358 bp, Artificial
  Mutation in BnaA.FAD2.a introduced by TALE nuclease pair BnFAD2_T05
cctctcctccctcaccctctcccttacctcgcctggcccctctcctgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47540 - DNA, 355 bp, Artificial
  Mutation in BnaA.FAD2.a introduced by TALE nuclease pair BnFAD2_T05
cctctcctccctcaccctctctcctactttgcctggcctctctactgggcctgcccagggtgcgtcctaaccggcgtctgggtcttagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttaa

SEQ ID NO: 47541 - DNA, 362 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47542 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgccaacccgccttcagcgactaccagtggcttgacgacaccgtcggcctcatcttcccctccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47543 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47544 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47545 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47546 - DNA, 357 bp, Artificial
  Mutation in BnaA.FAD2.a introduced by TALE nuclease pair BnFAD2_T05
cctctcctccctcaccctctcccttacctcgcctgccccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47547 - DNA, 355 bp, Artificial
  Mutation in BnaA.FAD2.a introduced by TALE nuclease pair BnFAD2_T05
cctctcctccctcaccctctaccttacctcgcctggcacctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 47548 - DNA, 351 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtcgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47549 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgccctaaccggcgtctgggtcatcgcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggggatgctaaccgtccagttcacgctcggctggcctttgtacttag

SEQ ID NO: 47550 - DNA, 358 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47551 - DNA, 353 bp, Artificial
  Mutation in BnaA.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47552 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47553 - DNA, 355 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 47554 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47555 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcacacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47556 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggccctttgtacttag

SEQ ID NO: 47557 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47558 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 47559 - DNA, 447 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccattattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttccttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47560 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacagcaagtggtacggcaagtacctcaacaagcctgtgggacgcaccgtgatgttaacggttcagttcactctcggctggcctttgtacttag

SEQ ID NO: 47561 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtccctttcttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47562 - DNA, 419 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgttggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47563 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggcttgacgacaccgtcggtctcatcttccactcctccctcctcgtcccttacttctcctggaagtacagtcatcgacgccaccattccaacactggctccctcgagagagacgaagtgtttgtccccaagaagaagtcacacatcaagtggtacggcaagtacctcaacaaccctttgggccgcaccgtgatgttaacggttcagttccctctcggctggcctttgtacttag

SEQ ID NO: 47564 - DNA, 390 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaagcggtgatcgccgaagtatcgactcaactatcagaggtagttggcgtcatcgagcgccatccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47565 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47566 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47567 - DNA, 396 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaggtggtggccatcgccaccacctgctccgccgctggaccgtctccgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47568 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatcgcccacgacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47569 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtgccaccacgccttcagcgactaccagtggctggacgacaccgtcggcctcatcttccactccttcctcctcgtcccttacttctcctggaagtacagtcatcgacgcaaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47570 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47571 - DNA, 362 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggcttgcctttgtacttag

SEQ ID NO: 47572 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccggccagttcacgctcggctggcctttgtacttag

SEQ ID NO: 47573 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctgtgggacgcaccgtgatgttaacggttcagttcactctcggctggcctttgtacttag

SEQ ID NO: 47574 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgcccaccagtggctggacgacgccgccggcctcgtcttccactccttcctcctcgtcccgtacttctcctggaagtacatccatgacgccatcattccaacaccggatccctcgatagggacgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 47575 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 47576 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggccttagtacttag

SEQ ID NO: 47577 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 47578 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47579 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47580 - DNA, 424 bp, Artificial
  Mutation in BnaA.FAD2.a introduced by TALE nuclease pair BnFAD2_T05
ctctcctccctcaccctctctcctacttcgcctggcctctctactgggcctgccagggctgcgtcctaaccggcgtctgggtcatagcccactagtgcggccaccgccattgctggcgatgagcgttcaccgacaaacaacagataaaacgaaaggcccagtcttaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47581 - DNA, 330 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47582 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacgaccctttgggacgcaccgtgatgttaacagttcagttctctctcggctggccgttgtacttag

SEQ ID NO: 47583 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47584 - DNA, 353 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47585 - DNA, 441 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcaagcaggcgctggagacggtccagcggctgttgccggttctgtgccatgcggggtcaagccgtgggcctggcacagcaccggccaccacgccttcagcgaccaccaggggcttgacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47586 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcgccaacacgccttcagccaccaccagtggctggacgacaccgtcggcctcatcttccactccttcctcctcgtcccttacttctcctagaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47587 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47588 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 47589 - DNA, 364 bp, Artificial
  Mutation in BnaA.FAD2.a introduced by TALE nuclease pair BnFAD2_T05
cctctcctccctcaccctctctcctacttcttctggcctctctactgtgcctgccaagggtgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattccaacactagctccctcgagagagacgaagtgtttgtccccaagaagaagtcagacatcaagtggtccggcaagtaccccaacacccctgtgggacgcacggggaagttaacggttcagctcactctcggctggcctttgtacttag

SEQ ID NO: 47590 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaacccgttgggacgcacggtgatgctaaccgtccagttcacgctcggctggcctttgtacttag

SEQ ID NO: 47591 - DNA, 419 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcggtacgcgtattaattgcgttgcgctcactgcccgcaaaaggccagcaaaaggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctgtgggacgcgccgtgatgttaacggttcaggtcactctcggctggccttggtacttag

SEQ ID NO: 47592 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 47593 - DNA, 435 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47594 - DNA, 471 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcttggcgatggcaagcaggcgctggagacggtccagcggctgttgccggtgctgtgccaggcccacggcttgaccccccagcaggtggtggccatcgccagcaataatggtggcaagcaggcgccaccccgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47595 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47596 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47597 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgaggttaacggttcagttcactctcggctggcctttgtacttag

SEQ ID NO: 47598 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaaccctttgggacgcaccgtgatgttaacgggtcagttctctctcggctggcctttgtacttag

SEQ ID NO: 47599 - DNA, 467 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagtccacgagtgcggccatcgccagcaatattggtggcaagcaggcgctggagacggtccagcggctgttgccggtgctgtgccaggcccacggcttgaccccccagcaggtggtggccatccaccacgccttcagcgaccaccagtggctggacgacgccgtgggcctcgtcttccactccttcctcctcgtcccttacttctcctggaagtacagccatcgacgccaccattacaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47600 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47601 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47602 - DNA, 363 bp, Artificial
  Mutation in BnaA.FAD2.a introduced by TALE nuclease pair BnFAD2_T05
cctctcctccctcaccctctctcctacttcgcctggcctctctacttggcctgccagggctgcgtcctaaccggcgtctgggtcatagcccacgagtgccccgccaccacgccttcagcgactaccagtggctggaccacaccgtcggcctcatcttccactccttcctcctcgtcccttacttctcctggaagtacagtcatcgacgccaccattccaacactggctcgctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47603 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagccactaccagtggctggacgacaccgtcggcctcatcttccactccttcctcctcgtcccttacttctcctggaagtacagtcatcgacgccaccattccaacactggctccctcgatagagacgaagtgtttgtccccaagaagaaatccgacatcaagtggtacggaaagtacctcaacaacccgctaggacgcacggtgatgctaaccgtccagttcacgatcggctggcctttgtacttag

SEQ ID NO: 47604 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacgccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47605 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcacgctcggctggcctttttacttag

SEQ ID NO: 47606 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47607 - DNA, 357 bp, Artificial
  Mutation in BnaA.FAD2.a introduced by TALE nuclease pair BnFAD2_T05
cctctcctccctcaccctctctcctacttcgcctggcctatctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaccaccggatccctcgatagggacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 47608 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtgccaccacgcctccagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47609 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47610 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgcctccattccaacactggctccctcgagagagacgaagtgtttgtccccaagaagaagtcagacatcaagtggtacggcaagtacctcaacaaccctttgggacgcaccgtgatgttaacggtccagttcacgcgcggctggcctttgtacttag

SEQ ID NO: 47611 - DNA, 363 bp, Artificial
  Mutation in BnaA.FAD2.a introduced by TALE nuclease pair BnFAD2_T05
ctctcctccctcaccctctctcctacttcgcctggcctctctactgggcctgccaagggtgcgtcctaaccggcgtctgggtcatcgcccacgaatgcggcgaccaccacgccttcagcgaccaccagtggctggacgacgccgtgggcctcgtcttccactccttcctcctcgtcccttacttctcctggaagtacagccatcgacgccaccattccaacaccggatccctcgagagggattaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47612 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgcccagttcacgctcggctggcctttgtacttag

SEQ ID NO: 47613 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47614 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggtctcatcttccactccttcctcctcgtcccttacttctcctagaagtacagtcatcgacgcctccattccaacactcgctccctcgagagagacgaagtgtttgtccccaagaagaagtcaaacatcgaatggtacggcaagtacctcaacaaccctttgggtcgcaccgtgatgttaacggttcagttcactctcggctggcctttgtacttag

SEQ ID NO: 47615 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacagccccttgggacgcaccgtgatgttaacggttcagttcactctcggctggcctttgtacttag

SEQ ID NO: 47616 - DNA, 364 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcggccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 47617 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagttgctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 47618 - DNA, 390 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47619 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47620 - DNA, 363 bp, Artificial
  Mutation in BnaA.FAD2.a introduced by TALE nuclease pair BnFAD2_T05
cctctcctccctcaccctctctcctacttcgcctggcctctctactgtgcctgccagggctgcgtcctaaccggcgtctgggtcatagcccacgagtgcggctccaccacgccttcagcgactaccagtggctggacgacaccgtcggcctcatcttccactccttcctcctcggcccttacttctcctggaagtacagtcatcgacgccaccattccaacactggctccctcgagagagacgaggtgtttgtcctaaagatgaagtcagaaaccaagtggtacggcaagtccctcaacaaccctttgggacgcaccgtgatgttaacggtttagttcactctcggattgcctttgtacctag

SEQ ID NO: 47621 - DNA, 333 bp, Artificial
  Mutation in BnaA.FAD2.a introduced by TALE nuclease pair BnFAD2_T05
cctctcctccctcaccctctaccttacctcgcctggcccctctactggacctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47622 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47623 - DNA, 354 bp, Artificial
  Mutation in BnaA.FAD2.a introduced by TALE nuclease pair BnFAD2_T05
cctctcctccctcaccctctctcctacttcgcctggcctctctactgggccggccagggctgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttggccccaagaagaagtcagacatcaagtggtacggcaagtacctcaacaaccctttgggacgcaccgtgatgttaacggttcagttcactctcggctggcctttgtacttag

SEQ ID NO: 47624 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47625 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47626 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47627 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 47628 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47629 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagcggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcgccgtgatgttaacagttcagttccctctcggctggcctttgtacttag

SEQ ID NO: 47630 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47631 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47632 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47633 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccccgccaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47634 - DNA, 355 bp, Artificial
  Mutation in BnaA.FAD2.a introduced by TALE nuclease pair BnFAD2_T05
cctctcctcctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47635 - DNA, 432 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47636 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccatggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtagctcaacacgccagagggacacaacatgatgttaacggttcagttcactctcggctggcctttgtacttag

SEQ ID NO: 47637 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtcttggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47638 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagtgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47639 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47640 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47641 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 47642 - DNA, 329 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccatttgggacgcaccgtgatgttaacggttcagttcacgctcggctggcctttgtacttag

SEQ ID NO: 47643 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctttgggacgcaccgcgatgttaacggttcagttcactctcggctggcctgtgtacttag

SEQ ID NO: 47644 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgagtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47645 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttccctctcggctggcctttgtacttag

SEQ ID NO: 47646 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 47647 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 47648 - DNA, 358 bp, Artificial
  Mutation in BnaA.FAD2.a introduced by TALE nuclease pair BnFAD2_T05
cctctcctccctcaccatctctcctacttcgcctggcctctctactgggcctgccagggctgcgtcctaaccggcgtctgggtcatagcccacgagtgccaccacgccttcagcgactacaagtggctggacgacaccgtcggcctcatcttccactccttcctcctcgtcccttacttctcctggaagtacagtcaccgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 47649 - DNA, 360 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtcgagttcacgctcggctggcctttatacttag

SEQ ID NO: 47650 - DNA, 432 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccatgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47651 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggctggacgacaccgtcggcctcatcttccactccttcctcctcctcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47652 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtcttggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgaggttaacggttcagttcactctcggctggcctttgtacttag

SEQ ID NO: 47653 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 47654 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47655 - DNA, 356 bp, Artificial
  Mutation in BnaA.FAD2.a introduced by TALE nuclease pair BnFAD2_T05
cctctcctccctcaccctctctcctacttagcctggcctctctactgggcctgccagggctgcgtcctaaccggcggctgggtcatagcccacgagtgaccacgccttcagcgactaccagtggctggacgacaccgtcggcctcatcttccactccttcctcctcggcccttacttctcctggaagtacagtcatcgacgccaccattccaacactggctccctcgagagagacgaagtgtttgtccccaagaagaagtcagacatcaagtggtacggcaattaccgccaccgccctttgtgtcgcaccgtgatgttcacaggtgagtgctctctcggctggcctttgtacttag

SEQ ID NO: 47656 - DNA, 430 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgcggatggcctttttgcgtttctacaaactcttcctggctagcggtacgcgtattaattgcgttgcgctcgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 47657 - DNA, 356 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47658 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 47659 - DNA, 364 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47660 - DNA, 371 bp, Artificial
  Mutation in BnaA.FAD2.a introduced by TALE nuclease pair BnFAD2_T05
cctctcctccctcaccctatctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47661 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatattccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47662 - DNA, 402 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtccctcaacacccctgtgggacgcaccgtgatgttaacggttcagttccctctcggctggcctttgtacttag

SEQ ID NO: 47663 - DNA, 347 bp, Artificial
  Mutation in BnaA.FAD2.a introduced by TALE nuclease pair BnFAD2_T05
cctctcctccctcaccctgtctcctacttcgcctggcctctcacctgagcctgccagggatgcgtcctaaccggcgtctgggttacagcacacgagcgcggccaactaccagtggctggacgacaccgtcggcctcatcttccactccttcctcctcgtcccttacttctcctggaagtacagccatcgacgccaccattccaacactggctccctcgagagagacgaactgtgtgtccccaataagaagtcagacatcaagtcgtacggcaagtagctcaacaaccgtttgggacgcaccgtgaggctacgcgtacagttcgctctcggccgccctttgtgcttag

SEQ ID NO: 47664 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcagctggcctttgtacttag

SEQ ID NO: 47665 - DNA, 358 bp, Artificial
  Mutation in BnaA.FAD2.a introduced by TALE nuclease pair BnFAD2_T05
cctctcctccctcaccctctctcctacttcgcctggcctctctactgagcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccgtttgggacgcaccgtgatgttaacggttcagttcactctcgtctggcctttgtacttag

SEQ ID NO: 47666 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47667 - DNA, 363 bp, Artificial
  Mutation in BnaA.FAD2.a introduced by TALE nuclease pair BnFAD2_T05
cctctcctccctcaccctctctcctacttcgcctggcctctctactggtcctgccagggctgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 47668 - DNA, 358 bp, Artificial
  Mutation in BnaA.FAD2.a introduced by TALE nuclease pair BnFAD2_T05
cctctcctccctcaccctctctcctacttcgcctggcctctcaactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagatcactctcggctggcctttgtacttag

SEQ ID NO: 47669 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggatgtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47670 - DNA, 435 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47671 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcaaacatcaagtggtacggcaagtacctcaacaaccctttgggacgcaccgtgatgttaacggttcagttcactctcggctggcctttgtacttag

SEQ ID NO: 47672 - DNA, 394 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgatggccaccacctgctggggggtcaagccgtgggccttgaccccgtcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47673 - DNA, 342 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47674 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47675 - DNA, 438 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaacgatgttacgcagcagggcagtcgccctaaaacaaagttaaacattatgagggaagcggtgatcgccgaagtatcgactaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47676 - DNA, 359 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47677 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47678 - DNA, 403 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcaggtggtggccatcgccagcaataatggtggcaagcaggcgctggagaaccacgccttcagcgactaccagtggctggacgacaccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47679 - DNA, 283 bp, Artificial
  Mutation in BnaA.FAD2.a introduced by TALE nuclease pair BnFAD2_T05
cctctcctccctcaccctttcccttaccacgcctttagcgaccaccagtggctggacgacgccgtgggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47680 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttccctctcggctggcctttgtacttag

SEQ ID NO: 47681 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcacagcccacgagtgcggccacgccttcagcgactaccagtggctggacgacaccgtcgtcctcatcttccactccttcctcctcgtccctttcttctcctggaagtacagtcatcgacgtcaccattccaacactggctccctcgagagagacgaagtgtttgtccccaagaagaagtcagacatcaagtggtgcgccaagtacctcaacaaccctttgggacgcaccgtgatgttaacggttcagttcactctcggctggcctttgtacttag

SEQ ID NO: 47682 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaaggagaagtcagacatcaagtggtacggcaagtacctcaacaaccctttgggacgcaccgtgatgttaacggttcagttcactctcggctggcctttgtacttag

SEQ ID NO: 47683 - DNA, 424 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaagttaacggttcagttcactctcggctggcctttgtacttag

SEQ ID NO: 47684 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 47685 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttat

SEQ ID NO: 47686 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacgtcaagtacctcagcaaccctttgggacgcaccgtgatgttaacggttcagttcactctcggctggcctttgtacttag

SEQ ID NO: 47687 - DNA, 362 bp, Artificial
  Mutation in BnaA.FAD2.a introduced by TALE nuclease pair BnFAD2_T05
cctctcctccctcaccctctctcctacttcgccgggcctctctactgggcctgccagggctgcgtcctaaccgcgttctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47688 - DNA, 351 bp, Artificial
  Mutation in BnaA.FAD2.a introduced by TALE nuclease pair BnFAD2_T05
cctctcctccctcaccctctcccttacctcgcctgtcccctctactgggcctgccaaggctgcgtcctaacgggcctctgggtcatagcccacgagtcgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47689 - DNA, 402 bp, Artificial
  Mutation in BnaA.FAD2.a introduced by TALE nuclease pair BnFAD2_T05
cctctcctccctcaccctgtctcctacttcgcctggcctctctactgggcctgccagggctgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaagcgtccaggtcacgctcggctggcctttgtacttag

SEQ ID NO: 47690 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggtagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47691 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggatgtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47692 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47693 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagtcatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47694 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47695 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47696 - DNA, 333 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagtcatcgacgccaccattccaacactggctccctcgagagagacgaagtgtttgtccccaagaagaagacagacatcaagtggtacggcaagtacctcaacaaccctgggggacgcagcgtgatggaaacggttcagttcactctgggctggcctttgtactgag

SEQ ID NO: 47697 - DNA, 435 bp, Artificial
  Mutation in BnaA.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggctggacgacgccgtgggcctcgtcttccactccttcctcctcgtcccttacttctccgggaagtacagtcatcgacgccaccattccaacactggctccctcgagagagacgaagtgtttgtccccaagaagaagtcagacatcaagtggtacggcaagtacctcaaccaccctctgggacgcaccgtgatgttaccggttcagttcactctcggctggcctttgtacttag

SEQ ID NO: 47698 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47699 - DNA, 402 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47700 - DNA, 355 bp, Artificial
  Mutation in BnaA.FAD2.a introduced by TALE nuclease pair BnFAD2_T05
cctctcctcctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47701 - DNA, 438 bp, Artificial
  Mutation in BnaA.FAD2.a introduced by TALE nuclease pair BnFAD2_T05
cctctcctccctcaccctttctcctacttcgcctggcctctctactgggcctgccagggctgcgtcctaaccggcgtctgggtcatagcccacgagtgcaacgatgttacgcagcagggcagtcgccctaaaacaaagttaaacattatgagggaagcggtgatcgccgaagtatcgactaccacgccttcagcgactaccagtggctggacgacaccgtcggcctcatcttccactccttcctcctcgtcccttacttctcctggaagtacagccatcgacgccaccatgccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 47702 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47703 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47704 - DNA, 446 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcggctgttgccggtgctgtgccaggcccacggcttgaccacggcttgaccccccagcaggtggtggccatcgccagtaatattggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 47705 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgatgatggaagtaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 47706 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgttcagttcactctcggctggcctttgtacttag

SEQ ID NO: 47707 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccagtgctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47708 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47709 - DNA, 437 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaacgatgttacgcagcagggcagtcgccctaaaacaaagttaaacattatgagggaagcggtgatcgccgaagtatcgactaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 47710 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47711 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaacccttggggacgcgccgtgatgttaacggtgcagttcactctcggctggcctttgtacttag

SEQ ID NO: 47712 - DNA, 346 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47713 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47714 - DNA, 403 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgtcgggtttcgccacctctggtggtggccatcgccagcaatggcggtgaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47715 - DNA, 356 bp, Artificial
  Mutation in BnaA.FAD2.a introduced by TALE nuclease pair BnFAD2_T05
cctctcctccctcaccctctctcctacttcacctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47716 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 47717 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47718 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 47719 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47720 - DNA, 352 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47721 - DNA, 360 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaaccggcgtctgggtcatagcccacgagtgtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 47722 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47723 - DNA, 358 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47724 - DNA, 333 bp, Artificial
  Mutation in BnaA.FAD2.a introduced by TALE nuclease pair BnFAD2_T05
cctctcctccctcaccctctctcctacttcgcctggcctctctactgggcctgagcaggttattgctggggggtcaccacgccttcagcgactaccagtggctggacgacaccgtctgcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacactttgggacgcaccgtgatgttaacggttcagttcactctcggctggcctttgtacttag

SEQ ID NO: 47725 - DNA, 355 bp, Artificial
  Mutation in BnaA.FAD2.a introduced by TALE nuclease pair BnFAD2_T05
ccctcctccctcaccctctctcctacttcgcctggcctctctactgggcctgccaagggtgcgtcctaaccggcgtctgggtcatagcccacgagtgaccacgccttcagcgactaccagtggctggacgacaccgtcggcctcatcttccactccttcctcctcgtcccttacttctcctggaagtacagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47726 - DNA, 351 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 47727 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtaccacgccttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47728 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactgggtccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47729 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaactgttcagttcactctcggctggcctttgtacttag

SEQ ID NO: 47730 - DNA, 471 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcttggcgatggcaagcaggcgctggagacggtccagcggctgttgccggtgctgtgccaggcccacggcttgaccccccagcaggtggtggccatcgccagcaataatggtggcaagcaggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47731 - DNA, 424 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtccctcaacaaccctttgggacgcaccgtgatgttaacggttcagttccctctcggctggcctttgtacttag

SEQ ID NO: 47732 - DNA, 357 bp, Artificial
  Mutation in BnaA.FAD2.a introduced by TALE nuclease pair BnFAD2_T05
cctctcctccctcaccctctccctaccccccctggcccctctactgggcctgccaaggctgcgtcctaacgggcctctgggtcatcccccacgaatgccaccccgccttcagcgactaccaagggccggacgacaccgtcggcctcatcttcccctccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcggttccctctaggctggcctttgtacttag

SEQ ID NO: 47733 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47734 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcacacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47735 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47736 - DNA, 357 bp, Artificial
  Mutation in BnaA.FAD2.a introduced by TALE nuclease pair BnFAD2_T05
cctctcctccctcaccctctaccttacctcgcctggcccctctactcggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 47737 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 47738 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 47739 - DNA, 394 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgatggccaccacctgctggggggtcaagccgtgggccttgaccccgtcagcgactaccagtggctggaccacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47740 - DNA, 358 bp, Artificial
  Mutation in BnaA.FAD2.a introduced by TALE nuclease pair BnFAD2_T05
cctctcctccctcaccctctcccttacctctccttgctcctctactgggcctgccaaggctgcgtcctaacgggcctctgggtcatcgcccacgaatgccaccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacggttcagttccctctcggctggcctttgtacttag

SEQ ID NO: 47741 - DNA, 392 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccactaacgaaacccgacaggactataaagataccaggcgtttccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47742 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47743 - DNA, 342 bp, Artificial
  Mutation in BnaA.FAD2.a introduced by TALE nuclease pair BnFAD2_T05
cctctcctccctcaccctctcacctacttcgcctggcctctctactgggcctgccagggctgcgtcctaaccggcgtctgggtcaccacgccttcagcgactaccagtggctggacgacaccgtcggcctcatcttacactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 47744 - DNA, 443 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47745 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacagtcatcgacgccaccattccaacactggctccctcgagagagacgaagtgtttgtccccaagaagaagtctgacttcaagtggtacggcaactacctcaacaaccctttgggacgcaccgtgatgttaacggttcagttctctctcggctggcctttgtacttag

SEQ ID NO: 47746 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47747 - DNA, 418 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggcgatggccaccacctgctggggggtcaagccgtggggtcaagccgtgggcctggcacagcaccggcaacagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47748 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtaagccaagtacctgaacgaccctttgggacgcacagtaaagttaacggtccagttcactctcggctggcctttgtacttag

SEQ ID NO: 47749 - DNA, 362 bp, Artificial
  Mutation in BnaA.FAD2.a introduced by TALE nuclease pair BnFAD2_T05
cctctcctccctcaccctctctcctacttcgcctcgcctctctactgggcctgccaagggtgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagtgcactctcggctggcctttgtacttag

SEQ ID NO: 47750 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47751 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 47752 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 47753 - DNA, 443 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcctcaagccgtgggcctggtccagcggctgttgccaccgccattgctggcgatggccaccacctgctggggggtcaagccgtgtgccaccacgccttcagcgactaccagtggctggacgacaccgtcggcctcaccttccactccttcctcctcgtcccttacttctcctggaagtacagtcagcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 47754 - DNA, 358 bp, Artificial
  Mutation in BnaA.FAD2.a introduced by TALE nuclease pair BnFAD2_T05
cctctcctccctcaccctctcccttacctcgcttggcccctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47755 - DNA, 319 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47756 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggccttagtacttag

SEQ ID NO: 47757 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 47758 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaactggcacagcaccggcaacagccgctggacaacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47759 - DNA, 394 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 47760 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccactagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47761 - DNA, 358 bp, Artificial
  Mutation in BnaA.FAD2.a introduced by TALE nuclease pair BnFAD2_T05
cctctcctccctcaccctctctcctacttcgcctggcctctctactcggcctgccagggctgcgccctaaccggcgtctgggtcatagcccacgagtgccaccacgccttcagcgaccaccagtggctggacgacgccgtgggcctcgtcttccactccttcctcctcgtcccttccttctcctggaagtacagtcatcgacgcctccattccaacactcgctccctcgagagagacgaagtgtttgtccccaagaagaagtcacacatcaagtggcacggcaggtacctaaacatccgtccgggccggagcgtgatgtaaacggttcggttccctccaggctggcttttgtgactag

SEQ ID NO: 47762 - DNA, 358 bp, Artificial
  Mutation in BnaA.FAD2.a introduced by TALE nuclease pair BnFAD2_T05
cctctcctccctcaccctctctcctacttcgcctggcctctttactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47763 - DNA, 441 bp, Artificial
  Mutation in BnaA.FAD2.a introduced by TALE nuclease pair BnFAD2_T05
cctctcctccctcaccctctcccttacctagcctggcccctctactgggcctgccaaggctgcgtcctaacgggcctctgggtcatcgcccacgaatgcaagcaggcgctggagacggtccagcggctgttgccggtgctgtgccatggggggtcaagccgtgggcctggcacagcaccggccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47764 - DNA, 348 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacagcaagtggtacggcaagtacctcaacaaccctttgggacgcaccgtgatgttaacggttcagttcactcgcggctggcctttgtacttag

SEQ ID NO: 47765 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtccgcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggtgacgctccgtgaggttaacggagcagttctctctcggctggcctttgtacgtag

SEQ ID NO: 47766 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 47767 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgggagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47768 - DNA, 358 bp, Artificial
  Mutation in BnaA.FAD2.a introduced by TALE nuclease pair BnFAD2_T05
cctctcctccctcaccctctctccaacttcgcctggcctctctactgggcctgccagggctgcgtcctaaccggcgtctgggtcatagcccacgagtgccaccacgccttaagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47769 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47770 - DNA, 424 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccagtccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47771 - DNA, 430 bp, Artificial
  Mutation in BnaA.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgccaggcccacggcaacagccgctggaccgtctccagcgcctgcttgccaccattatcgctggcgatggtcacccaccacgccttcagcgactaccagtggctggacgacaccgtcggcctcatcttccactccttcctcctcgtcccttacttctccttgaagtacagtcatcgacgccaccattccaacactggctccctcgagagagactaagtgtttgcccccaagaagaagtcacacatcacgtggttcggcaatcacctcaacagcccgctaggtcgcagggtgaggctaagcggccagttcacgcgcccgtggccttagtacttag

SEQ ID NO: 47772 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47773 - DNA, 341 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgcctcagcgaccaccagtggctggacgacgccgtgggcctcgtcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47774 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcggctaccagtggctggacgacaccgtcggcctcatcttccactccttcctcctcgtcccttacttctcctggaagtacagtcatcgacgccaccattccaacactggctccctcgagagagacgaagtgtttgtccccaagaagaagccacacatcaagtggtacggcaagtaccccaacaaccgtctgggacgcagcgtgaggttaacggctcaggtcaggctcggctggccttggtacttag

SEQ ID NO: 47775 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggatgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47776 - DNA, 354 bp, Artificial
  Mutation in BnaA.FAD2.a introduced by TALE nuclease pair BnFAD2_T05
cctctcctccctaccctctctcctacttcgcctggcctctctactgggcctgccagggctgcgtcctaaccggcgtctgggtcatagcccacgaaaaccacgccttcagcgactaccagtggctggacgacaccgtcggcctcatcttccactccttcctcctcgtcccttacttctcctggaagtacagtcatcgacgccacaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47777 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggatgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtgcttag

SEQ ID NO: 47778 - DNA, 419 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcggtacgcgtattaattgcgttgcgctcactgcccgcaaaaggccagcaaaaggccaccacgccttcagcgactaccagtggctggacgacaccgtcggcctcatcttccactccttcctcctcgtcccttacttctcctggaagtacagtcatcgacgccaccagtccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 47779 - DNA, 359 bp, Artificial
  Mutation in BnaA.FAD2.a introduced by TALE nuclease pair BnFAD2_T05
cctctcctccctcaccctctcccttacctcgcctggcccctctactggacctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47780 - DNA, 329 bp, Artificial
  Mutation in BnaA.FAD2.a introduced by TALE nuclease pair BnFAD2_T05
cctctcctccctcaccctctctcctacttcgcctggaatctctactgggcctgccagggctgcgtcctaaccggcgtctgggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggcgggcctttgtacttag

SEQ ID NO: 47781 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgccaccacgccttcagcgaccaccagtggctggacgacgccgccggcctcgtcttccactccttcctcctcgtcccttacttctcctggaagtacagtcatcgacgccaccattccaacactggctccctcgagagagacgaagtgtttgtccccaagtagaagtcagacatcaagtggtacggcaagtacctcaacaaccctttgggacgcaccgtgatgttaacggttcagttcactctcggctggcctttgtacttag

SEQ ID NO: 47782 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 47783 - DNA, 390 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47784 - DNA, 345 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccccgagagagacgaagtgtttgtccccaagaagaagtcagacatcaagtggtacggcaagtacctcaacaaccctttgggacgcaccgtgatgttaactgttcagttcactctcggctggcctttgtacttag

SEQ ID NO: 47785 - DNA, 319 bp, Artificial
  Mutation in BnaA.FAD2.a introduced by TALE nuclease pair BnFAD2_T05
cctctcctccctcaccctctctcctacttcgcctgccctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47786 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 47787 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgaaccgtgatgttaacggttcagttctctctcggctggcatgtgtacgtag

SEQ ID NO: 47788 - DNA, 353 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 47789 - DNA, 430 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgcggatggcctttttgcgtttctacaaactcttcctggctagcggaacgcgtattaattgcgttgcgctcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcgagtggtacggcaagtacctcagcaaccctttgggacgcaccgtggtgttaacggttcggttccctctcggctggcctttgtacctag

SEQ ID NO: 47790 - DNA, 358 bp, Artificial
  Mutation in BnaA.FAD2.a introduced by TALE nuclease pair BnFAD2_T05
cctctcctccctcaccctctctcctacttcgcctggcctctctactgggcctgcctagggtgcgtcctaaccggcgtctgggtcatagcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47791 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 47792 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47793 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggatgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgagtttaacggttcagttcactctcggctggccttggtacttag

SEQ ID NO: 47794 - DNA, 355 bp, Artificial
  Mutation in BnaA.FAD2.a introduced by TALE nuclease pair BnFAD2_T05
cctctcctccctcaccctctatcctacttcgcctggactctctactgggcctgccagggctgcgtcctaaccggcgtctgggtcatagcccacgagtaccacgccttcagcgactaccagtggctgaacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcgagtacctcaacaaccctttgggacgcaccgtgatgttaacggttcagttcacgctcgggtggcctttgtacttag

SEQ ID NO: 47795 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtccggcaagtacctcaacaaccctttgggacgcaccgtgatgttaacggttcagttcactctcggctggcctttgtacttag

SEQ ID NO: 47796 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtccgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtccttag

SEQ ID NO: 47797 - DNA, 358 bp, Artificial
  Mutation in BnaA.FAD2.a introduced by TALE nuclease pair BnFAD2_T05
cctctcctccctcaccctctcacttacctcgcctggcctctctactgggcctgccaagggtgcgtcctaaccggcctctgggtcatcgcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47798 - DNA, 424 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47799 - DNA, 350 bp, Artificial
  Mutation in BnaA.FAD2.a introduced by TALE nuclease pair BnFAD2_T05
cctctcctccctcaccctctctcctacttcgcctggtctctctactgggcctgccagggctgcgtcctaaccggcgtctgggtcatagcccacgagtgcggccagcgactaccagtggctggacaacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47800 - DNA, 395 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaacagccgctggaccacgccttcagcgaccaccagtggctggacgacgccgtgggcctcgtcttccactccttcctcctcgtaccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47801 - DNA, 362 bp, Artificial
  Mutation in BnaA.FAD2.a introduced by TALE nuclease pair BnFAD2_T05
cctctcctccctcaccctctctcctacttcgcctggcatctctactgggcctgccaagggtgcgtcctaaccggcgtctaggtcatagcccacgagtgcgggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47802 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47803 - DNA, 359 bp, Artificial
  Mutation in BnaA.FAD2.a introduced by TALE nuclease pair BnFAD2_T05
cctctcctccctcaccctctgtcctacttcgcctggcctctctaatgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgcctccattccaacactggctccctcgagagagacgaagtgtttgtccccaagaagaagtcagacatcaagtggtacggcaagtacctcaacaaccctttgggacgcaccgtgattttaacggttcaggtcactctcggccggccttagtacttag

SEQ ID NO: 47804 - DNA, 331 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcggacatcaagtggtacggcaagtacctcaacaaccctttgggacgcaccgtgatgttaacggttcagttcactctcggctggcctttgtgcttag

SEQ ID NO: 47805 - DNA, 446 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcggctgttgccggtgctgtgccaggcccacggcttgaccacggcttgaccccccagcaggtggtggccatcgccagcaatattggtcaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47806 - DNA, 329 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47807 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtaccacgccttcagcgactaccagtggcttgacgacaccgtcggcctcatcctccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccggtaggacgcacggtgatgctaaccgtccagttcacgctcggctggcctttgtacttag

SEQ ID NO: 47808 - DNA, 360 bp, Artificial
  Mutation in BnaA.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcggtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47809 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 47810 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47811 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47812 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcgccgtgatgttaacggttcagttcactctcggctggcctttgtacttag

SEQ ID NO: 47813 - DNA, 355 bp, Artificial
  Mutation in BnaA.FAD2.a introduced by TALE nuclease pair BnFAD2_T05
cctctcctccctcaccctctcacctacttcgcctggcctctctactgggcctgccaagggtgcgtcctacccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgggatgttaacggtgcagttcactcgcggctggcctgtatacttag

SEQ ID NO: 47814 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47815 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgacttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggccttggtacttag

SEQ ID NO: 47816 - DNA, 450 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagcggctgttgccggtgctgtgccaggcccacggcttgcccccccgctccggggtctggccatcgccagccacgatggcggcaacagccgctggacccaccacgccttcagcgactaccagtggctggacgccaccctcggcctcatcttccactccttcctcctcttccctttcttctcctggaagtacagtcatcgactccaccattccaacactggctccctcgagagagacgaagtgtttgtccccaagaagaagtcagacatcaagtggtacggcaagtacctcaacaaccctttgggacgcgccgtggtgttaacggttcagttcactctcggctggccttggtacttag

SEQ ID NO: 47817 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccagtccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47818 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47819 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagtcatcgacgccacccttccaacactggctccctcgagacagacgaagtgtttgtccccaagaagaagtcagacatcaagtggtacggcaactacctcaacaaccctttgggacgccccgtgatgttaacggttcagttcactcccggctggcctttgtacttag

SEQ ID NO: 47820 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47821 - DNA, 447 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccgccattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacatctcctggaagtacagccatcgacgccaccattccaacaccggatccctcgagagagacgaagtgtttgtccccaagaagaagtcagacatcaagtggtacggcaagtaccgcaacaaccctttgggacgcaccgtgatgttaacggttcaggtcactctcggctggcctttgtacttag

SEQ ID NO: 47822 - DNA, 359 bp, Artificial
  Mutation in BnaA.FAD2.a introduced by TALE nuclease pair BnFAD2_T05
cctctcctccctcaccctctctcttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47823 - DNA, 350 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47824 - DNA, 443 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcctcaagccgtgggcctggtccagcggctgttgccaccgccattgctggcgatggccaccacctgctggggggtcaagccgtgtgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtctagttcacgctcggctggcctttgtacttag

SEQ ID NO: 47825 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcttcccttacttctcctggaagtacagtcatcgacgccaccattccaacactggctccctcgagagagacgaagtgtttgtccccaagaagaagtcacacatcaagtgttacggcgagtacctcagcaaccctctgggacgcaccgtgaggttaacggttcagttcacgctcggctggcctttgtgcttag

SEQ ID NO: 47826 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 47827 - DNA, 346 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 47828 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 47829 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47830 - DNA, 443 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcctcaagccgtgggcctggtccagcggctgttgccaccgccattgctggcgatggccaccacctgctggggggtcaagccgtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 47831 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47832 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 47833 - DNA, 362 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 47834 - DNA, 435 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgttggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47835 - DNA, 330 bp, Artificial
  Mutation in BnaA.FAD2.a introduced by TALE nuclease pair BnFAD2_T05
cctgtcctccctcaccctctctcctacttcgcctggcctctctactgggcctgccaagggtgcgtcctaacgggcctctgggtcatagcccacgagtgctggacgacaccgtcggcttcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47836 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatagcccacgagtgctggacgacaccgtcggcttcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47837 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcttcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47838 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47839 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcgccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 47840 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 47841 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47842 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggatgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 47843 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47844 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttgagttcactctcggctggcctttgtacttag

SEQ ID NO: 47845 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 47846 - DNA, 356 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgtgtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47847 - DNA, 355 bp, Artificial
  Mutation in BnaA.FAD2.a introduced by TALE nuclease pair BnFAD2_T05
cctctcctccctcaccctctctcctacttcgcctggcctctctacttggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47848 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 47849 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgacaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 47850 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacgaccgtctaggacgcgcggtggtgctaaccgtccaggtcgcgctcggctggccttggtacgtag

SEQ ID NO: 47851 - DNA, 357 bp, Artificial
  Mutation in BnaA.FAD2.a introduced by TALE nuclease pair BnFAD2_T05
cctctcctccctcacctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 47852 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 47853 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggcgggcctttgtacttag

SEQ ID NO: 47854 - DNA, 353 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47855 - DNA, 347 bp, Artificial
  Mutation in BnaA.FAD2.a introduced by TALE nuclease pair BnFAD2_T05
ccctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47856 - DNA, 358 bp, Artificial
  Mutation in BnaA.FAD2.a introduced by TALE nuclease pair BnFAD2_T05
cctctcctccctcaccctctctcctacttcgcctggcctctctactgggcctgcaaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47857 - DNA, 358 bp, Artificial
  Mutation in BnaA.FAD2.a introduced by TALE nuclease pair BnFAD2_T05
cctctcctccctcaccctctcccttacctcgcctggtccctctactgggcctgccaaggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47858 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagaccacgaaccacgccttcagcgactaccagtggctggacgacaccgtcggcctcatcttccactccttcctcctcgtccctaacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47859 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagcgactaccagtggctggacgacaccgtcgacctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47860 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 47861 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggcaagtacctcaacaacccttggggacgcaccgtgatgttaacggttcagttcactctcggctggcctttgtacttag

SEQ ID NO: 47862 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcatgctcggctggcctttgtacttag

SEQ ID NO: 47863 - DNA, 430 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaggcccacggcaacagccgctggaccgtctccagcgcctgcttgccaccattattgctggcgatggccacccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47864 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47865 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccaactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47866 - DNA, 433 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcggcaaacaaaccaccgctggtagcggtggtttttttgtttgcaagcagcagattacgcgcagaaaaaaaggacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgtaaacggttcagttcactctcggctggcctttgtacttag

SEQ ID NO: 47867 - DNA, 330 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgctggacgacaccgtcggcttcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 47868 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47869 - DNA, 358 bp, Artificial
  Mutation in BnaA.FAD2.a introduced by TALE nuclease pair BnFAD2_T05
cctctcctccctcaccctctcccttacctcgcctacaccctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcatgtaccgcaacaacccttgtggacgcaccgtgatgttaacggtgcagttcactcgcggctggccattgtacgtag

SEQ ID NO: 47870 - DNA, 358 bp, Artificial
  Mutation in BnaA.FAD2.a introduced by TALE nuclease pair BnFAD2_T05
cctctcctccctcaccctctctcctacttcgcctggcctccctactaggcctgccagggctgcgtcctaaacggcgtctgggtcatcgcccacgagtgccaccacgccttcagcgactaccagtggctggacgacaccgtcgggctcatcttccactccttcctcctcgtcccttacttctcctggaagtacaggcatcgacgccaccattccaacaccggatccctcgagagggatgaagtgttcgtccccaagaagaagtcagacatcaagtggtacggcaagtacctcaacaacccgctgggacgcaccgtgatgttaacggtgcatgtcactctcggctggcctttgtacttag

SEQ ID NO: 47871 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 47872 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47873 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactatcagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47874 - DNA, 419 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcggtacgcgtattaattgcgttgcgctcactgcccgcaaaaggccagcaaaaggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctatgacgcacggtgatgctaaccgtccagttcacgctcggctggcctttgtacttag

SEQ ID NO: 47875 - DNA, 280 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47876 - DNA, 357 bp, Artificial
  Mutation in BnaA.FAD2.a introduced by TALE nuclease pair BnFAD2_T05
cctctcctccctcaccctctctcctacttcgcctggcctctccactgggcctgccaagggtgcgtcctaaccggcgcctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 47877 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgacttag

SEQ ID NO: 47878 - DNA, 401 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47879 - DNA, 407 bp, Artificial
  Mutation in BnaA.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgccattgctggcgatggccacaacctgctggggggtcaagccgtgggcctggcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctttgtacttag

SEQ ID NO: 47880 - DNA, 340 bp, Artificial
  Mutation in BnaA.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgctaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47881 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctctaggacgcacggtgatgctaaccgtccagttcacgctcggctggcctttgtacttag

SEQ ID NO: 47882 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47883 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggcttcctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47884 - DNA, 398 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgtcgggtttcggcaggtggtggccatcgccagcaatggcggtgaccacgccttcagcgactaccagtggctggacgacaccgtcggcctcatcttccactccttcctcctcgtcccttacttcccctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47885 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 47886 - DNA, 350 bp, Artificial
  Mutation in BnaA.FAD2.a introduced by TALE nuclease pair BnFAD2_T05
cctctcctccctcaccctctgtcctacttcgcctggcctctctaatgggcctgccaaggctgcgtcctaaccggcgtctgggtcatagcccacgagtgaggccagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 47887 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 47888 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatcgcccacgacaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47889 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggccgttgtacttag

SEQ ID NO: 47890 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 47891 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47892 - DNA, 371 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatcccttttggacgcaccgtgatgttaacggttcagttcactctcggctggcctttgtacttag

SEQ ID NO: 47893 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 47894 - DNA, 371 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaaccggcgtctgggtcatagcccacgagtcttcctggcggccgccaccacgccttcagcgactaccagtggcttgacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgttgggacgcacggtgatgttaacggttcagttcactctcggctggcctttgtacttag

SEQ ID NO: 47895 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtagctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47896 - DNA, 447 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggctagccacgatggcggctagccacggtggtggccatcgccagccacgatggcggcaagcaggcgctggagcctggcacagcaccggccaccacgccttcagcgactaccagtggctggacgacaccctcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgaggctaaccgtccagttcacgctcggctggcctttgtacgtag

SEQ ID NO: 47897 - DNA, 362 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47898 - DNA, 358 bp, Artificial
  Mutation in BnaA.FAD2.a introduced by TALE nuclease pair BnFAD2_T05
cctctcctccctcaccctctctcctacttcgcctggcctctctactgggcctgctagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47899 - DNA, 362 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47900 - DNA, 355 bp, Artificial
  Mutation in BnaA.FAD2.a introduced by TALE nuclease pair BnFAD2_T05
cctctcctccctcaccctctcccttacctcgcctggcccatctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtacccaagaagaagtcagacatcaagtggtacggcaagtacctcaacaaccctttgggacgcaccgtgatgttaacggttcagttcactctcggctggcctttgtacttag

SEQ ID NO: 47901 - DNA, 341 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 47902 - DNA, 358 bp, Artificial
  Mutation in BnaA.FAD2.a introduced by TALE nuclease pair BnFAD2_T05
cctctcctccctcaccctctcacttacctcgcctggcccctctactgggcctgccaaggctgcgtcctaacgggcctctgggtcatcgcccacgaatgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47903 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47904 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggatggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47905 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacaccgtcggcctcatcttccactccttcctcctcgtcccttacttctcctggaagtacagtcatcgacgccaccattccaacacaggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 47906 - DNA, 354 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagaccacgccttcagcgactaccagtggctggacgacaccgtcggcctcatcttccactccttcctcctcgtcccttacttctcctggaagtacagtcatcaacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47907 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgcttcagttcactctcggctggcctttgtccttag

SEQ ID NO: 47908 - DNA, 363 bp, Artificial
  Mutation in BnaA.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgcggggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47909 - DNA, 349 bp, Artificial
  Mutation in BnaA.FAD2.a introduced by TALE nuclease pair BnFAD2_T05
cctctcctccctcaccctctctcctacttcgcctggcctctcccctcggcctgccagggatgcgtcctaaccggcgtctgggtcatagcccaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcagcaaccgtttgggacgcaccgtggggttaacggttcagttcacgctcggcgggcctttgtgcttag

SEQ ID NO: 47910 - DNA, 345 bp, Artificial
  Mutation in BnaA.FAD2.a introduced by TALE nuclease pair BnFAD2_T05
cctctcctccctcaccctctcccttacctcgcctggcccctctactgtgcctgccaagtctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47911 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttagcggttcagttcactctcggctggcctttgtacttag

SEQ ID NO: 47912 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtgcctcaacagccctttgggacgcaccgtgatgttaacggttcagttcactctcggctggcctttgtacttag

SEQ ID NO: 47913 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47914 - DNA, 363 bp, Artificial
  Mutation in BnaA.FAD2.a introduced by TALE nuclease pair BnFAD2_T05
cctctcctccctcaccctctctcctactccgcctggcctctctaataggcctgccagggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcaggtcactctcggctggcctttgtacttag

SEQ ID NO: 47915 - DNA, 352 bp, Artificial
  Mutation in BnaA.FAD2.a introduced by TALE nuclease pair BnFAD2_T05
cctctcctccctcaccctctctcctacttcgcctggcctctctactgggcttgccaagggtgcgtcctaaccggcgtctgggtcatagcccaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtaccccgacaacccttttggacgcaccgtgatgttaacggttcagttcactctcggctggcctttgtacttag

SEQ ID NO: 47916 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccttcggcctcatcttccactccttcctcctcgtcccttacttctcctggaagtacagtcatcgacgccaccagtccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47917 - DNA, 355 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47918 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgagacgcaccgtgatgttaacggttcagttcactctctgctggcctttgtacttag

SEQ ID NO: 47919 - DNA, 358 bp, Artificial
  Mutation in BnaA.FAD2.a introduced by TALE nuclease pair BnFAD2_T05
cctctcctccctcaccctctctcctacttcgcctggcctctctaccgggcctgccaagggtgcgtcctaaccggcgtctgggtcatagcccacgagtgccaccaccccttcatcaaccaccagtggctggacgacgccgtcggcctcgtcttcctctccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47920 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 47921 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 47922 - DNA, 357 bp, Artificial
  Mutation in BnaA.FAD2.a introduced by TALE nuclease pair BnFAD2_T05
cctctcctccctcaccctctcccctacttcgcctgtcacatacactgggcctgccagggctgcgtcctaaccggcgtctgggtaatagcccacgagtgacaccacgccttcagcgactaccagtggctggacgaccccgtcggcctcatcttccactccttcctcctcgtcccttacttctcctggaagtacagtcatcgacgccaccattccaacactggctccctcgagagagacgaagtgtttgtcccaagaagaagtcagacatcaagtggtacggcaagtacctcaacaaccctttgggacgcaccgtgatgttaacggttcagttcactctcggctggcctttgtacttag

SEQ ID NO: 47923 - DNA, 383 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcctccagctgctgttgccggtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47924 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttccttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47925 - DNA, 358 bp, Artificial
  Mutation in BnaA.FAD2.a introduced by TALE nuclease pair BnFAD2_T05
cctctcctccctcaccctctctcctacttcgcctggcaactctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatggtaacggttcagttcactctcggctggcctttgtacttag

SEQ ID NO: 47926 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47927 - DNA, 357 bp, Artificial
  Mutation in BnaA.FAD2.a introduced by TALE nuclease pair BnFAD2_T05
cctctcctccctcaccctctctcctacttcgcctggactctctactgggcctgccaagggtgcgcactaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctctgaggcgcacagtgaagttaacggttcagttcactctcggctggcctttgtacttag

SEQ ID NO: 47928 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47929 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 47930 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtatttag

SEQ ID NO: 47931 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggccccatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47932 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47933 - DNA, 358 bp, Artificial
  Mutation in BnaA.FAD2.a introduced by TALE nuclease pair BnFAD2_T05
cctctcctccctcaccctctctcctacttcgcctggcatgtctactgggcctgccagggctgcgtcctaaccggcgtctgggtcatagcccacgagtgcggccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctttgggacgcaccgtgagggtaacggttcagtgcactctcggctggcctttgtacttag

SEQ ID NO: 47934 - DNA, 353 bp, Artificial
  Mutation in BnaA.FAD2.a introduced by TALE nuclease pair BnFAD2_T05
cctctcctccctcaccctttcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacagcccgttgggaagcaccgtgatgttaacggttcagttcactctcggctggcctttgtacttat

SEQ ID NO: 47935 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaggtgtttgtccccaagaagaagtcagacatcaagtggtacggcaagtacctcaacaaccctttgggacgcaccgtgatgttaacggttcagttcactctcggctggcctttgtacttag

SEQ ID NO: 47936 - DNA, 349 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaaccggcgtctgggtcatagcccaccacgccttcagcgactaccagtggctggacgacaccgtcggcctcgtcttccactccttcctcctcgtcccttacttctcctggaagtacagtcatcgacgccaccattccaacactggctccctcgagagagacgaagtgtttgtccacaagaagaagtcagacatcaagtggtacggcaagtacctcaacaaccctttgggacgcaccgtgatgttaacggttcagttcactctcggctggcctttgtacttag

SEQ ID NO: 47937 - DNA, 402 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcacacgagtgcggcttcccctggagagagcgagattctccgcgctgtagaagtcacaccacgccttcagcgactaccagtggctggacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 47938 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaacccttggggacgcaccgtgatgttaacggttcagttcactctcggctggccttgtacttag

SEQ ID NO: 47939 - DNA, 283 bp, Artificial
  Mutation in BnaA.FAD2.a introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacactggctccctcgagagggatgaagtgttcgtccccaagaagaagtcagacatcaagtggtacggcaagtacctcaacaaccctttgggacgcaccgtgatgttaacggttcaggtcactctcggctggccgttgtacttag

SEQ ID NO: 47940 - DNA, 346 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47941 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 47942 - DNA, 418 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggcgatggccaccacctgctggggggtcaagccgtggggtcaagccgtgggcctggcacagcaccggcaacagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 47943 - DNA, 358 bp, Artificial
  Mutation in BnaA.FAD2.a introduced by TALE nuclease pair BnFAD2_T05
cctctcctccctcaccctctcccttacctcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47944 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggttgcgtcctaaccggcgtctgggtcatagcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47945 - DNA, 356 bp, Artificial
  Mutation in BnaA.FAD2.a introduced by TALE nuclease pair BnFAD2_T05
cctctcctccctcaccctgtctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtttttgtccccaagaagaagtcagacatcaagtggtacggcaagtacctcaacaaccctttgggacgcaccgtgatgttaacggttcagttcactctcggctggcctttgtacttag

SEQ ID NO: 47946 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacacaccgtgatgttaacggttcagttcactctcggctggcctttgtacttag

SEQ ID NO: 47947 - DNA, 357 bp, Artificial
  Mutation in BnaA.FAD2.a introduced by TALE nuclease pair BnFAD2_T05
cctctcctccctcaccctttctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 47948 - DNA, 333 bp, Artificial
  Mutation in BnaA.FAD2.a introduced by TALE nuclease pair BnFAD2_T05
cctctcctccctcaccctctctcctacttcgcctggcctctctactaggcctgagcaggttattgctggggggtcaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47949 - DNA, 347 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcggccaactaccagtggctggacgacaccgtcggccccatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47950 - DNA, 350 bp, Artificial
  Mutation in BnaA.FAD2.a introduced by TALE nuclease pair BnFAD2_T05
cctctcctccctcaccctctcccttacctcgcctggcctctctactgggcctgccaaggctgcgtcctaaccggcgtctgggtcatagcccacgagtgcggccagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaagtcagacataaagtggtacggcaagtaccttaacaaccctttgggacgcaccgtgatgttaacggttcagttcactctcggctggcctttgtacttag

SEQ ID NO: 47951 - DNA, 443 bp, Artificial
  Mutation in BnaA.FAD2.a introduced by TALE nuclease pair BnFAD2_T05
cctctcctccctcaccctctctcttacctcgcctggcccctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47952 - DNA, 347 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgagtcatagcccacgagtgcggccaactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaacccgtttggacgcaccgtgatgttaacgggtcagttcactctcggctggcctgtgtacttag

SEQ ID NO: 47953 - DNA, 355 bp, Artificial
  Mutation in BnaA.FAD2.a introduced by TALE nuclease pair BnFAD2_T05
cctctcctccctcaccctgtctcctacttcgcctggcctctccactgggcctgccagggctgcgtcctaacaggcgtctgggtaatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaattgcctcaacatcccgctaggacgcacggtgatgcagaccgtccagtgcacgctcggctggcctttgtgcttag

SEQ ID NO: 47954 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47955 - DNA, 360 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 47956 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccttaacaaccctttgggacgcaccgggatgttactggtgcaggtcactctctgctggcctgtgtacttag

SEQ ID NO: 47957 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagccaacgagtgcggcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47958 - DNA, 329 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47959 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47960 - DNA, 358 bp, Artificial
  Mutation in BnaA.FAD2.a introduced by TALE nuclease pair BnFAD2_T05
cctctcctccctcaccctttctcctacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtccctcaacaaccctttgggacgcaccgtgatgttaacggttcagttcactctcggctggcctgtgtacgtag

SEQ ID NO: 47961 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47962 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47963 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgccaacggttcagttcactctcggctggcctttgtacttag

SEQ ID NO: 47964 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47965 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47966 - DNA, 435 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47967 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 47968 - DNA, 430 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaggcccacggcaacagccgctggaccgtctccagcgcctgcttgccaccattattgctggcgatggccacccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47969 - DNA, 402 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 47970 - DNA, 430 bp, Artificial
  Mutation in BnaA.FAD2.a introduced by TALE nuclease pair BnFAD2_T05
cctctcctccctcaccctctctcctacttcgcctggcccctctactgggcctgccagggctgcgtcctaaccggcgtctgggtcatagcccacgagtgcgcggatggcctttttgcgtttctacaaactcttcctggctagcggtacgcgtattaattgcgttgcgctcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctaaacaaccctttgggacgcaccgtgatgttaacggttcagttcacgctcggctggcctttgtacttag

SEQ ID NO: 47971 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 47972 - DNA, 343 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47973 - DNA, 355 bp, Artificial
  Mutation in BnaA.FAD2.a introduced by TALE nuclease pair BnFAD2_T05
cctctcctccctcaccctttcacctacttcgcctggcaactctcctaggcctgccagggctgcgtcccacccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47974 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47975 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgccaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagcacctcagcatgcctccgggccgccccgtgatgttaacggttcagttcccgctcggctgccctctgtacttag

SEQ ID NO: 47976 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 47977 - DNA, 355 bp, Artificial
  Mutation in BnaA.FAD2.a introduced by TALE nuclease pair BnFAD2_T05
cctctcctccctcaccctttctcctacttcgcctggcctctctactgggcctgccagggctgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacacgggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47978 - DNA, 390 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47979 - DNA, 390 bp, Artificial
  Mutation in BnaA.FAD2.a introduced by TALE nuclease pair BnFAD2_T05
cttctcctccctcaccctctcccttacctcgcctggcccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47980 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctagggcgcacggtgatgctaaccgtccagttcacgctcggctggccgttgtacttag

SEQ ID NO: 47981 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47982 - DNA, 356 bp, Artificial
  Mutation in BnaA.FAD2.a introduced by TALE nuclease pair BnFAD2_T05
cctctcctccctcaccctttctcctacttcgcctggcatctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47983 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggctggactacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47984 - DNA, 358 bp, Artificial
  Mutation in BnaA.FAD2.a introduced by TALE nuclease pair BnFAD2_T05
cctctcctccctcaccctctctcctacttcgcctggcctctctactggtcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47985 - DNA, 350 bp, Artificial
  Mutation in BnaA.FAD2.a introduced by TALE nuclease pair BnFAD2_T05
cctctcctccatcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcacgctcggctggcctttgtacttag

SEQ ID NO: 47986 - DNA, 410 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatattggtggcaagcaggcgctggagacggtgcaggcgctgttgccggtgctgtgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47987 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47988 - DNA, 347 bp, Artificial
  Mutation in BnaA.FAD2.a introduced by TALE nuclease pair BnFAD2_T05
cctctcctccctcaccctctctcctacttcgcctggcctctctactaggcctgccagggctgcgtcctaaccggcgtctgggtcatagcccacgagtgcggccaactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactttcggctggcctttgtacttag

SEQ ID NO: 47989 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtcaccaagaagaagtcagacatcaagtggtacggcaagtacctcaacaaccctttgggacgcaccgtgatgttaacggttcagttcactctcggctggcctttgtacttag

SEQ ID NO: 47990 - DNA, 362 bp, Artificial
  Mutation in BnaA.FAD2.a introduced by TALE nuclease pair BnFAD2_T05
cctctcctccctcaccctctctcctacttcgcctggcctctctactcggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacatccctgtgggacgcaccgtgatgttaacggttcagttcactctcggctggcctttgtacttag

SEQ ID NO: 47991 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47992 - DNA, 355 bp, Artificial
  Mutation in BnaA.FAD2.a introduced by TALE nuclease pair BnFAD2_T05
cccctcctccctcaccctctcccttacctcgcctggcccctctactgggcctgccaaggctgcgtcctaacgggcctctgggtcatcgcccacggccaccacgccttcagcgaccaccagtggctggacgccgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47993 - DNA, 447 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccattattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47994 - DNA, 354 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 47995 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctttacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47996 - DNA, 355 bp, Artificial
  Mutation in BnaA.FAD2.a introduced by TALE nuclease pair BnFAD2_T05
cctctcatccctcaccctctcccttacctcgcctggcccctctactgggcctgccagggctgcgtcctaaccggcgtctgggtcatagcccacgagtaccacgccttcagcgactaccagtggctggacgacaccgtcggcctcatcttccactccttcctcctcgtcccttacttctactggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47997 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 47998 - DNA, 438 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaacgatgttacgcagcagggcagtcgccctaaaacaaagttaaacattatgagggaagcggtgatcgccgaagtatcgactaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 47999 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48000 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 48001 - DNA, 356 bp, Artificial
  Mutation in BnaA.FAD2.a introduced by TALE nuclease pair BnFAD2_T05
cctctcctccctcaccctctctcctacttcgcctggcatctctactgggcctgccaagggtgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 48002 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48003 - DNA, 353 bp, Artificial
  Mutation in BnaA.FAD2.a introduced by TALE nuclease pair BnFAD2_T05
cctctcctccctcaccctctcccttacctcgcctcgcccctctactgggcctgccaaggctgcgtcctaacgggcctctgggtcatctcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 48004 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48005 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48006 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacagcaagtggtacggcaagtacctcaacaaccctttgggacgcaccgtgatgttaacggttcagttcactctcggctggcctttgtacttag

SEQ ID NO: 48007 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggccgcatcttccactccttcctcctcgtcccttacttctcctggaagtacagtcatcgacgccaccattccaacactggctccctcgagagagacgaagtgtttgtccccaagaagaagtcagccatcaagtggtacggcaggtacctcaacaaccctgtggaacgcaccgtgatgttaacggttcatttcactctcggctggcctgagtacttag

SEQ ID NO: 48008 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctgtgtacttag

SEQ ID NO: 48009 - DNA, 403 bp, Artificial
  Mutation in BnaA.FAD2.a introduced by TALE nuclease pair BnFAD2_T05
cctctcctccctcaccctctctcctacttcgcctggcctctatactgggcctgccagggctgcgtcctaaccggcgtctgggtcatagcccacgagcaggtggtggccatcgccagcaataatggtggcaagcaggcgctggagaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccacaacaaccctttggggcgcaccgtgatgttaacggttcagttcactctaggctggcctgtgtactgag

SEQ ID NO: 48010 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 48011 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48012 - DNA, 362 bp, Artificial
  Mutation in BnaA.FAD2.a introduced by TALE nuclease pair BnFAD2_T05
cctctcctccctcaccctctctcctacttcgtctggcctccctactgggcttgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaagttaacggttcagttcactctcggctggcctgtgtacttag

SEQ ID NO: 48013 - DNA, 394 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcattgctcatcaatttgttgcaacgaacaggtcactatccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 48014 - DNA, 358 bp, Artificial
  Mutation in BnaA.FAD2.a introduced by TALE nuclease pair BnFAD2_T05
cctctcctccctcaccctctctcctacttcgcctggcccctccactcggcctgccaagggtgcgtcctaaccggcgcctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaggtacctcagcatccctttgggacgcaccgtggggttaaccgttcggttcacgctcggctggcctcagtacttag

SEQ ID NO: 48015 - DNA, 401 bp, Artificial
  Mutation in BnaA.FAD2.a introduced by TALE nuclease pair BnFAD2_T05
cctctcctccctcaccctctctcctacttcgcctggcctctctactgggcctgcccgggctgcgtcctaaccggcgtctgggtcatcgcccacgaatgcggctgttgccggtgctgtgccaggcccacggctttaccccggccaccccgccttcagcgaccacccgtggctggacgacgccgttgtcctcgtcttccactccttcctcctcgtcccttacttctcctggaagtacagccatcgacgccaccattccaacacccgatccctcgagagggatgaagtgtttgtccccaagaagaagtcagacatcaagtggtacggcaagtacctcaacaaccctttgggacgcaccgtgattttaacggttcagttcactctcggctggcctttgtacttag

SEQ ID NO: 48016 - DNA, 363 bp, Artificial
  Mutation in BnaA.FAD2.a introduced by TALE nuclease pair BnFAD2_T05
cctctcctccctcaccctctcccttacctcgcctggcacctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagtcatcgacgccaccattccaacactggctccctcgagagagactaagtgtttgtccccaagaagaagtcagacatcaagtggtacggcaattacctcaacaaccctttgggacgcaccgtgatgttaacggttcagttcactctcggctggcctttgtacttag

SEQ ID NO: 48017 - DNA, 333 bp, Artificial
  Mutation in BnaA.FAD2.a introduced by TALE nuclease pair BnFAD2_T05
cctctcctccctcaccctctctcctacttcgcctggcctctctactgggcctgagcaggttattgctggggggtcaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48018 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 48019 - DNA, 354 bp, Artificial
  Mutation in BnaA.FAD2.a introduced by TALE nuclease pair BnFAD2_T05
ccttcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48020 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48021 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggcttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 48022 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48023 - DNA, 471 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcttggcgatggcaagcaggcgctggagacggtccagcggctgttgccggtgctgtgccaggcccacggcttgaccccccagcaggtggtggccatcgccagcaataatggtggcaagcaggcgccaccacgccttcagcgactaccagtggctggacgacaccgtcggcctcatcttccactccttcctcctcgtcccttacttcgcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 48024 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 48025 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 48026 - DNA, 359 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggaccacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48027 - DNA, 401 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccatcgccagccacgatggcggcaaacagccgctggacaccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48028 - DNA, 390 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaagcggtgatcgccgaagtatcgactcaactatcagaggtagttggcgtcatcgagcgccatccaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48029 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttacactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48030 - DNA, 352 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtccggcaagtacctcaacaaccctttgggacgcaccgtgatgttaacggttcagttcactctcggctggcctttgtacttag

SEQ ID NO: 48031 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48032 - DNA, 347 bp, Artificial
  Mutation in BnaA.FAD2.a introduced by TALE nuclease pair BnFAD2_T05
cctctcctccctcaccctctcccttacctcgcctggcccctctactgggcctgcccacgctgcgtcctaatcggcgtctgggtcatcgcccacgagtgcggccaactaccagaggctggacgacaccgtcggcctcatcttccactccttcctcctcgtcccttacttctcctggaattacagtcatcgacgccaccactccaacactggccccctcgagagagacgaagtgtttgtccccaagaagaagtcagacatcaagtgatacggcaaggacctcaacaaccctttgggacgcaccgtgatgttaacggttcagttcactcgcggctggcctgtgtacttag

SEQ ID NO: 48033 - DNA, 360 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48034 - DNA, 355 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcttcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48035 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctgtgtacttag

SEQ ID NO: 48036 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccggccaccacgccttcagcgactaccagtggctggacgacaccgtcggcctcatcttccactccttcctcctcgtcccttacttctcctggaagtacagtcatcgacgccaccattccaacactggctccctcgagagagacgaagggtttgtccccaagaagaagtcagacatcaagtggtacggcaagtacctcaacaaccctttgggacgcaccttgatgttaacggttcagttcactctcggctggcctttgtacttag

SEQ ID NO: 48037 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccgccgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgaggttaacggttcagttcactctcggctggcctgtgtacttag

SEQ ID NO: 48038 - DNA, 342 bp, Artificial
  Mutation in BnaA.FAD2.a introduced by TALE nuclease pair BnFAD2_T05
cctctcctccctcaccctctctcctacttcgcctggcttctctactgggcctgccagggctgcgccctaaccggcgtctgggtcaccacgccttcagcgactaccagtggctggacgacaccgtcggcctcatcttccactccttcctcctcgtcccttacttctcctggaagtacagtcatcgacgccaccattccaacactcgctccctcgagagagacgaagtgtttgtccccaagaagaagtcagacatcacctcgtacggcaagtacctcaacatccctccgaaacgcaccgtgaggtaaacggcacagttccctctccgatgccctctgtgcctac

SEQ ID NO: 48039 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaggtcagaccccaagtggtccgccaattccccaaccacccctttgggaggcaccgagaggttacgggttcagttcgcttgcggctgcccttttccctag

SEQ ID NO: 48040 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48041 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 48042 - DNA, 394 bp, Artificial
  Mutation in BnaA.FAD2.a introduced by TALE nuclease pair BnFAD2_T05
cctctcctccctcaccctctaccttacctcgcctggcccctctactgggcctgccaaggctgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctccttgaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48043 - DNA, 391 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcttctagctgataaattcatgccggagagggtggccaccacgccttcagcgactaccagtggctggacgacaccgtcggcctcatcttccactccttcctcctcgtcccttacttctcctggaagtacagtcatcgacgccaccattccaacactggctcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48044 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacccctccatcaaccacaaggggctggtcgacgccgccggcgtcgtcttcccctcctccctcctcgtcccgtacttcttctggaagtacatccatgacgccaccattccaacaccggatccctcgatagggacgaagtgttcgtccccaagaagaaatccgacatcaagtggtacggcaagtacctcaacaaccctttgggacgcaccgtgatgttaacggttcagttcactcgcggctggccttggtacttag

SEQ ID NO: 48045 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaaaaaccctttgggacgcaccgtgatgttaacggttcagttcactctcggctggcctttgtacttag

SEQ ID NO: 48046 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 48047 - DNA, 344 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 48048 - DNA, 342 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcttaaccggcgtctgggtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48049 - DNA, 349 bp, Artificial
  Mutation in BnaA.FAD2.a introduced by TALE nuclease pair BnFAD2_T05
cctctcctccctcaccctctctcctacttcgcctggcatctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48050 - DNA, 363 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcggcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgggtggcctgtgtacttag

SEQ ID NO: 48051 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcagtcctttgtacttag

SEQ ID NO: 48052 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaggaagaagccagccatcaagtggtacggcaagtccctcacaaaccctttgggacgcaccgtgaggtaaacggttcagttcccgctgggctgcctttgtacttag

SEQ ID NO: 48053 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 48054 - DNA, 390 bp, Artificial
  Mutation in BnaA.FAD2.a introduced by TALE nuclease pair BnFAD2_T05
cctctcctccctcaccctctcccttacctcgcctggcccctctaccgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 48055 - DNA, 359 bp, Artificial
  Mutation in BnaA.FAD2.a introduced by TALE nuclease pair BnFAD2_T05
cctctcctccctcaccctctctcctacttcgcctggcccctctactcggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48056 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccatggctgcgtcctaaccggcgtctgggtcatagcccacgagtgcggcgcccccaccccttcagcgactaccagtggctggacgacaccgtcggcctcatcgtccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48057 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcggacatcaagtggtacggcaagtacctcaacaaccctttgggacgcaccgtgatgttaacggttcagttcactctcggctggcctttgtacttag

SEQ ID NO: 48058 - DNA, 356 bp, Artificial
  Mutation in BnaA.FAD2.a introduced by TALE nuclease pair BnFAD2_T05
cctctactccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgaggttaacggttcagttgactctcgcctggcctttgtacttag

SEQ ID NO: 48059 - DNA, 346 bp, Artificial
  Mutation in BnaA.FAD2.a introduced by TALE nuclease pair BnFAD2_T05
cctctcctccctcaccctctcccttacctcgcctggcctctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgaggttaacggttcagttctctctcggcgggcctttgtacttag

SEQ ID NO: 48060 - DNA, 348 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggccttgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48061 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggtttacggtacggttcactcccggccggcttcagtgcttag

SEQ ID NO: 48062 - DNA, 348 bp, Artificial
  Mutation in BnaA.FAD2.a introduced by TALE nuclease pair BnFAD2_T05
cctctcctccctcaccctctcccttacctcgcctggcccctctaccgggcctgccaaggctgcgtcctaccgggcctctgggtcatcgccaccacgccttcagcgaccaccagtggctggacgacgccgtgggcctcgtcttccactccttcctcctcgccccttacttctcctggaagtacagccatcgacgccaccattccaacactggctccctcgagagagacgaagtgtttgtccccaagaagaagtcacacatcaagtggtacggcaagtacctcaacaaccctttgggacgcaccgtgattttaacggttcagttcactctcggctggcctttgtacttag

SEQ ID NO: 48063 - DNA, 358 bp, Artificial
  Mutation in BnaA.FAD2.a introduced by TALE nuclease pair BnFAD2_T05
cctctactccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48064 - DNA, 330 bp, Artificial
  Mutation in BnaA.FAD2.a introduced by TALE nuclease pair BnFAD2_T05
cctctcctccctcaccctctcacttacctcgcctggcccatctcatgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgaggttaacggttcagttcactctcggctggcctgtgtacttag

SEQ ID NO: 48065 - DNA, 363 bp, Artificial
  Mutation in BnaA.FAD2.a introduced by TALE nuclease pair BnFAD2_T05
cctctcctccctcaccctctcccttacctcgcctggcccctctaatgggcctgccaaggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48066 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacgctggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48067 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttaagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48068 - DNA, 359 bp, Artificial
  Mutation in BnaA.FAD2.a introduced by TALE nuclease pair BnFAD2_T05
cctctcctccctcaccctctcacttacctcgcctggcacctctactgggcctgccaaggctgcgtcctaacgggcctctgggtcatcgcccacgaatgcccaccacgccttcagcgaccaccagtggctggacgacgccgtgggcctcgtctcccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctgtgtacttag

SEQ ID NO: 48069 - DNA, 396 bp, Artificial
  Mutation in BnaA.FAD2.a introduced by TALE nuclease pair BnFAD2_T05
cctctcctccctcaccctctctcctacatcgcctggcctctctactgggccatcgccagcaataatggtggcaagcaggcgctggagacggtccagcggctgttgccggtgctgtgccaggcccacggcttgacccccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48070 - DNA, 356 bp, Artificial
  Mutation in BnaA.FAD2.a introduced by TALE nuclease pair BnFAD2_T05
cctctcctccctcaccctctatcctacttcgcctggaatctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggttatgctaaccgtccagttcacgctcggctggcctttgtacttag

SEQ ID NO: 48071 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccatttgggacgcaccgtgatgttaacggttcagttcactctcggctggcctttgtacttag

SEQ ID NO: 48072 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactcccagtggctggacgacaccgtcggcctcttcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48073 - DNA, 392 bp, Artificial
  Mutation in BnaA.FAD2.a introduced by TALE nuclease pair BnFAD2_T05
cctctcctccctcaccctctctcctacttcgcctggcatatctactgggcctgccagggctgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacgggtcagttcactctcggctggcctttgtacttag

SEQ ID NO: 48074 - DNA, 362 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctcccttgagagagacgaagtgtttgtccccaagaagaagtcagacatcaagtggtacggcaagtacctcaacaaccctttgggacgcaccgtgagtttaacggttcagttcactctcggctggcctttgtacttag

SEQ ID NO: 48075 - DNA, 350 bp, Artificial
  Mutation in BnaA.FAD2.a introduced by TALE nuclease pair BnFAD2_T05
cctctcctccctcaccctctctcctacttcgcctggactctctacagggcctgccagggctgcgtcccaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctttgggacgcaccgtgatgttagcggtgtagttcgctctcggctggccttggtacttag

SEQ ID NO: 48076 - DNA, 360 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48077 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48078 - DNA, 362 bp, Artificial
  Mutation in BnaA.FAD2.a introduced by TALE nuclease pair BnFAD2_T05
cctctcctccctcaccctctctcctacttcgcttggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48079 - DNA, 357 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcaccacgccttcagcgactaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48080 - DNA, 424 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48081 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 48082 - DNA, 345 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaacgggcctctgggtcatcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48083 - DNA, 363 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48084 - DNA, 362 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48085 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48086 - DNA, 356 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaagtcccacatcaagtggtacggcacgtatcgcaaccaccgtcagggacgcatagtggagtgactcgcccccttcaccctaggctggcctttgtacttag

SEQ ID NO: 48087 - DNA, 449 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcagggattttggtcatgggtggctcgagggttatttgccgactaccttggtgatctcgcctttcacgtagtggacaaattcttccaactggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48088 - DNA, 357 bp, Artificial
  Mutation in BnaA.FAD2.a introduced by TALE nuclease pair BnFAD2_T05
cctctcctccctcaccctctaccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 48089 - DNA, 353 bp, Artificial
  Mutation in BnaA.FAD2.a introduced by TALE nuclease pair BnFAD2_T05
cctctcctccctcaccctctatcctacttcgcctggcctctctactgggcctgccaagggtgcgtcctaactggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 48090 - DNA, 447 bp, Artificial
  Mutation in BnaA.FAD2.a introduced by TALE nuclease pair BnFAD2_T05
cctctcctccctaaccctctctcctacttcgcctggcctctctactgggcctgccagggctgcgtcctaaccggcgtctgggtcatagcccacgagtgcggctagccacgatggcggctagccacggtggtggccatcgccagccacgatggcggcaagcaggcgctggagcctggcacagccccggccaccacgccctcagcgactaccagtggctggacgacaccgtccgcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48091 - DNA, 362 bp, Artificial
  Mutation in BnaA.FAD2.a introduced by TALE nuclease pair BnFAD2_T05
cctctcctccctcaccctctctcctacttcgcctggactctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48092 - DNA, 362 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcgtccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaagcctttggggtgtaccgtaatgttaccggttcagttctctctcggctggcctttgtacgtag

SEQ ID NO: 48093 - DNA, 383 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagtcatcgacgccaacattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48094 - DNA, 358 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcatagcccacgagtgtcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48095 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48096 - DNA, 329 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaacccttggggacgcaccgtgatgttaacggttcaggtcactctcggctggcctttgtacttag

SEQ ID NO: 48097 - DNA, 357 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 48098 - DNA, 362 bp, Artificial
  Mutation in BnaA.FAD2.a introduced by TALE nuclease pair BnFAD2_T05
cctctcctccctcaccctctctcctacttcgcctggcatctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctaggctggcctttgtacttag

SEQ ID NO: 48099 - DNA, 396 bp, Artificial
  Mutation in BnaA.FAD2.a introduced by TALE nuclease pair BnFAD2_T05
cctctcctccctcaccctctcccttacctcgcctggcccctctactgggcctgccagggctgcgtcctaaccggcgtctgggtcatagcccacgagtggtggccatcgccagcaatggcggtggcaagcaggcgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 48100 - DNA, 350 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtggcttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggccggcctgtgtacttag

SEQ ID NO: 48101 - DNA, 353 bp, Artificial
  Mutation in BnaA.FAD2.a introduced by TALE nuclease pair BnFAD2_T05
cctctcctccctcaccctatctcctacttcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48102 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggcctgtgtacttag

SEQ ID NO: 48103 - DNA, 358 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaaccggcgtctgggtcatagtccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48104 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 48105 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48106 - DNA, 403 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaggtggtggccatcgccagcaataatggtggcaagcaggcgctggagaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48107 - DNA, 358 bp, Artificial
  Mutation in BnaA.FAD2.a introduced by TALE nuclease pair BnFAD2_T05
cctctcctccctcaccctctcacctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactatcggctggcctttgtacttag

SEQ ID NO: 48108 - DNA, 358 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 48109 - DNA, 349 bp, Artificial
  Mutation in BnaA.FAD2.a introduced by TALE nuclease pair BnFAD2_T05
cctctcctccctcaccctctcccttacctcgcctggcctctctactgggcctgcaaagggtgcgtcctaaccggcgtctgggtcatagcccaccacgctttcagcgactaccagtggctggacgacgccgtgggcctcgtcttccactccttcctcatcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48110 - DNA, 330 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48111 - DNA, 356 bp, Artificial
  Mutation in BnaA.FAD2.a introduced by TALE nuclease pair BnFAD2_T05
cctctcctccctcaccctctctcctacttcgcctggcctatctcctgggcctgtcagggctgcgtcctaaccggcgtctgggtcatagcccacgagccaccacgccttcagccactaccagtggctggacgacaccgtcctcctcatcttccaccccttcctcctcctcccttacttctcctggaagtacagtcatcgacgcccccattccaacactggctccctcgagagagacgaagtgtttgtccccaagacgaagtcagacatcgagtggtacggcaagtacctcaacaaccctttgggacgcaccgtgatgtaaccggttcaggtcactctcgggcgccctgtgtacttag

SEQ ID NO: 48112 - DNA, 356 bp, Artificial
  Mutation in BnaA.FAD2.a introduced by TALE nuclease pair BnFAD2_T05
cctctcctccctcaccctctcccttacctcgcctggcccctctactgggcctgccaaggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48113 - DNA, 330 bp, Artificial
  Mutation in BnaA.FAD2.a introduced by TALE nuclease pair BnFAD2_T05
cctctcctccctcaccctctctcctacttcgcctggcctctctcctgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgattctaaccgtccagttcacgctcggctggcctttgtacttag

SEQ ID NO: 48114 - DNA, 359 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48115 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgaaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 48116 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggctggacgacaccgtcggcctcatcttccactccttactcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48117 - DNA, 353 bp, Artificial
  Mutation in BnaA.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgcggccttcagcgactaccagtggccggacgacaccgtcggcctcatcttccactccttactcctcgtcccttacttctcctggaagtacagtcatcgacgccaccattccaacactggctccctcgagagagacgaagtgtttgtccccaagaataagtcagacatcaagtggtacggcaagtacctcaacaaccctttgggacgcaccgtgatgttaacggttcagttcactcccggctggcctttgtacttag

SEQ ID NO: 48118 - DNA, 353 bp, Artificial
  Mutation in BnaA.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctgtgtacttag

SEQ ID NO: 48119 - DNA, 356 bp, Artificial
  Mutation in BnaA.FAD2.a introduced by TALE nuclease pair BnFAD2_T05
cctctcctccctcaccctctatcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48120 - DNA, 357 bp, Artificial
  Mutation in BnaA.FAD2.a introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggctatgtacttag

SEQ ID NO: 48121 - DNA, 359 bp, Artificial
  Mutation in BnaA.FAD2.a introduced by TALE nuclease pair BnFAD2_T05
cctctcctccctcaccctctcccctacttcgcctggcctctctactgggcctgccagggctgcgtcctaaccggcgtctgggtcatagcccacgagtgcccaccacgccttcagcgactaccagtgactggacgacaccgtcggcctcatcttccactccttcctcctcgtcccttacttctcctggaagtacagtcatcgacgccaccattccaacactggctccctcgagagagacgaagtgtttgtccccaagaagaaggcagacatcaagtggtacggcaagtacctcaacaaccctttgggacgcaccgtgatgttaacggttcagttcactctcggctggcctttgtacttag

SEQ ID NO: 48122 - DNA, 358 bp, Artificial
  Mutation in BnaA.FAD2.a introduced by TALE nuclease pair BnFAD2_T05
cctctcctccctcaccctctctcctgcttcgcgtggcctctctactgggcctgccagcgctgagccctaaccggcgtctggatcatagcccacgagtgccaccccgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagccagacatcaagtggcacggcaagtacctcaacgaccctttgggacgcaccgtgatgttaacggttcagttcactctcggctggcctttgtacttag

SEQ ID NO: 48123 - DNA, 362 bp, Artificial
  Mutation in BnaA.FAD2.a introduced by TALE nuclease pair BnFAD2_T05
cctctcctccctcaccctctctcctacttcgcctggcatctctactgggcctgccagggctgcgtcctaaccggcgtctgggtcatagcccacgagtgcgggccaccaccccttcagcgacttccagtggctgaacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggcaagtacctcaacaacccgttgggacgcaccgtgatgttaacggttcagttcacgctcggctggcctttgtacttag

SEQ ID NO: 48124 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48125 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48126 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaagtcacacatcgagtggtacggcaactacctcaacatccctctggaccgccccgtggttttaacgcttcggttccctccagcatggcctttgcgcttac

SEQ ID NO: 48127 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccccgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48128 - DNA, 379 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgagcctttcgttttatttgatgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48129 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48130 - DNA, 349 bp, Artificial
  Mutation in BnaC.FAD2.a introduced by TALE nuclease pair BnFAD2_T05
cctctcctccctcaccctctctcctacttcgcctggcctctctactgggcctgcaaagggtgcgtcctaaccggcgtctgggtcatagcccaccacgctttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48131 - DNA, 349 bp, Artificial
  Mutation in BnaC.FAD2.a introduced by TALE nuclease pair BnFAD2_T05
cctctcctccctcaccctctctcctacttcgcctggcctctctactgggcctgcaaagggtgcgtcctaaccggcgtctgggtcatagcccaccacgctttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48132 - DNA, 331 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48133 - DNA, 358 bp, Artificial
  Mutation in BnaC.FAD2.a introduced by TALE nuclease pair BnFAD2_T05
cctctcctccctcaccctctctcctacttcgcctggcctctctacttggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 48134 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagcggcttgacgaccccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48135 - DNA, 353 bp, Artificial
  Mutation in BnaC.FAD2.a introduced by TALE nuclease pair BnFAD2_T05
cctctctccctcaccctctctcctacttcccctggcctctctactgcgcctgccatggctgcgtcctcaccggcgtctgggtcatagcccacgagaccacgccttcagcgactaccagtggcttgacgacaccgccggtctcctcttccactccctcctcctcgtcccttacttctcctggaagtacagtcatcgacgccaccattccaccactggctccctcgaaagagacgaagtgtttgtccccaagaacaagtctcacatcgcgtggtacggcaagtacctcaacatccctttgggacgccccgtgatgtaaacggttcagttcactctcggctggccttagtacttac

SEQ ID NO: 48136 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48137 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48138 - DNA, 353 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48139 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48140 - DNA, 280 bp, Artificial
  Mutation in BnaC.FAD2.a introduced by TALE nuclease pair BnFAD2_T05
cctctcctccctcaccctctctcctacttcgcctggcctctctactgggcctgtcaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48141 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48142 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagaaagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48143 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgcctccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48144 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctcctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48145 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48146 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacaacccttttggacgcaccgtgatgttaacggttcagttcactctcggctggcctttgtaattag

SEQ ID NO: 48147 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48148 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48149 - DNA, 328 bp, Artificial
  Mutation in BnaC.FAD2.a introduced by TALE nuclease pair BnFAD2_T05
cctctcctccctcacactctctcctacttcgcctggcctctctactgggcctgccaagggcgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggatggccttagtgcttag

SEQ ID NO: 48150 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48151 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacgccaagtacctcaacaaccctttgggacgcaccgtgatgttaacggttcagttcactctcggctggcctttgtacttag

SEQ ID NO: 48152 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtcttggtcatagcccacgagtgcggggccaccacgccttcagcgactaccagtggcttgacgacaccgtcggtctcatcttccactccttcctcctcgtcccttacttctcctggaagtacagtcatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48153 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccccgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48154 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccagcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48155 - DNA, 354 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48156 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48157 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48158 - DNA, 323 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48159 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgagtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48160 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48161 - DNA, 358 bp, Artificial
  Mutation in BnaC.FAD2.a introduced by TALE nuclease pair BnFAD2_T05
cctctcctccctaaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48162 - DNA, 349 bp, Artificial
  Mutation in BnaC.FAD2.a introduced by TALE nuclease pair BnFAD2_T05
cctctcctccctcaccctctctcctacttcgcctggcctctctactgggcctgcaaagggtgcgtcctaaccggcgtctgggtcatagcccgccacgctttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctgccctttgtacttag

SEQ ID NO: 48163 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48164 - DNA, 356 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48165 - DNA, 353 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48166 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48167 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48168 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48169 - DNA, 358 bp, Artificial
  Mutation in BnaC.FAD2.a introduced by TALE nuclease pair BnFAD2_T05
cctctcctccctcaccctctcccctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48170 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaaaggtgcgtcctaaccggccactccttcctcctcgtcccttacttctcctggaagtacagtcatcgacgccaccattccaacactggctcactcgagagagacgaagtgtttgtccccaagaagaagtcagccatcaagtggtacggcaagtacctctacaaccctttgggacgccccgtgatgttaacggttcagttcactcgcggctggcctttgtacttag

SEQ ID NO: 48171 - DNA, 358 bp, Artificial
  Mutation in BnaC.FAD2.a introduced by TALE nuclease pair BnFAD2_T05
cctctccttcctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccaacatcaagtgctacggaaagtacctcagcagcccgctaggacgcgcgatgatgctaaccgtccagtgcactctcggctggccttggtacttag

SEQ ID NO: 48172 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48173 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgatgatggaagtaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 48174 - DNA, 353 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggccttggtactta

SEQ ID NO: 48175 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcgagtggtacggcaagtagctcagcaaccctttgggacgcaccgtgatgttaacggttcagttcactcccggctggcctctgtacctag

SEQ ID NO: 48176 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtatggcaagtacctcaacaaccctttgggacgcaccgtgatgttaacggttcagttcactctcggctggcctttgtacttag

SEQ ID NO: 48177 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48178 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48179 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccatcacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48180 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctttgtacttag

SEQ ID NO: 48181 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48182 - DNA, 356 bp, Artificial
  Mutation in BnaC.FAD2.a introduced by TALE nuclease pair BnFAD2_T05
cctctcctccatcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48183 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgatgatggaagtaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48184 - DNA, 392 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48185 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 48186 - DNA, 462 bp, Artificial
  Mutation in BnaC.FAD2.a introduced by TALE nuclease pair BnFAD2_T05
cctctcctccctcaccctctctcctacttcgcctggcctccctactgggcctgccaagggagcgtcctaaccggcgtctgggtcatagcccacgagtgactccagcgcctgcttgccgccatcgtggctccgccaccctccgggccgttccttcacaacgttcaaatccactcccggcggatttgtcctactcaggagagcgtcaccacgccttcaccgactaccagtggcttgacgacaccgtcggtctcatcttccactccttcctcctcctcccttacttctcctggaagtacagccatcgacgccaccactccaacaccggacccctcgagagggatgaagtgttcgtccccaagaagaagaccgacatcgagtggtacggagagtacctcaacaccccgctggaatgcccggtgacgctcaccgtccagttcacgctcggctgccctgtgtacttag

SEQ ID NO: 48187 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48188 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48189 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48190 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48191 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtcgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48192 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48193 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 48194 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaagccgacatcaagtggtacggaaagtacctcaacaaccctttgggacgcaccgtgatgttaacggtgcagttcactctcggctggcctttgtacttag

SEQ ID NO: 48195 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 48196 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48197 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48198 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctgtgggacgcaccgggatgttaacggttcatttcacgctcggctggcctttgtacttag

SEQ ID NO: 48199 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48200 - DNA, 363 bp, Artificial
  Mutation in BnaC.FAD2.a introduced by TALE nuclease pair BnFAD2_T05
gcctctcctccctcaccctccctcctacttcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48201 - DNA, 358 bp, Artificial
  Mutation in BnaC.FAD2.a introduced by TALE nuclease pair BnFAD2_T05
cctctcctccctcaccctctctcctacttcgcctggcgtctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaatcctttgggtcgcaccgtgaggttaacgggtcagttttctctcggctggcctgtgtacttag

SEQ ID NO: 48202 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaactcagacatcaagtggtacggcaagtacctcaacaaccctttgggacgcaccgtgatgttaacggttcagttcactctcggctggcctttgtacttag

SEQ ID NO: 48203 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48204 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaacgggcctctgggtcatcgcccacgaatgtccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48205 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48206 - DNA, 362 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccaggtcacgctcggctggcctgtgtacttag

SEQ ID NO: 48207 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 48208 - DNA, 331 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttggcacgcaccgtgatgttaacggttcagttcactctcggctggcctttgtacttag

SEQ ID NO: 48209 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccaggggcgtgacgacaccgtcggcctcatcttccactccttcctcctcgtcccttacttctcctggaagtacactcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48210 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgggatgttaaccgtccagttcacgctcggctggcctttgtacttag

SEQ ID NO: 48211 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48212 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctttgtacttag

SEQ ID NO: 48213 - DNA, 346 bp, Artificial
  Mutation in BnaC.FAD2.a introduced by TALE nuclease pair BnFAD2_T05
cctctcctccctcaccctctctcctacttcgcctggcctctctactgcgcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 48214 - DNA, 462 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgactccagcgcctgcttgccgccatcgtggctccgccaccctccgggccgttgcttcacaacgttcaaatccgctcccggcggatttgtcctactcaggagagcgtcaccacgccttcagcgactaccagtggcttgacgacaccgtcggtctcatcttccactcctccctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcgccgggatgttaacggttcaggtcactctcggctggccttggtacttag

SEQ ID NO: 48215 - DNA, 362 bp, Artificial
  Mutation in BnaC.FAD2.a introduced by TALE nuclease pair BnFAD2_T05
cctctcctccctcaccctctctcctacttcgcctggcatacctcatgagcctgccaagggagcgtcctaaccggcgtctgggtcatagcccacgagtgcggcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaagccgacatcaagtggtacggaaagtacctcaacaacccgctaggacgcacggtgatgctaaccgtccaggtcacgcgcggctggcctgtgtacttag

SEQ ID NO: 48216 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccttggtacttag

SEQ ID NO: 48217 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 48218 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccgacgtctgggtcatagcccacgagaccacgccttcagcgactaccagaggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacgggaagtacctcagcaacccgccagaacgcacggtgatgctaaccggccagttcacgctcggctggcctttgtgcttag

SEQ ID NO: 48219 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcttcctaacctgcgtctgggtcatctcccacgagtgccaccacgccttcagcgactaccagtggcttgacgtcaccgtcggtctcatcttccactccttcctcctcgtaccttacttctcctggaagtacagtcatcgacgccaccattccaacactggctccctcgagagagacgaagtgtttgtccccaagaagaagtcagacatcaagtggtacgacaggtacctcaacaaacctttgggacgcaccgtgatgttaacggtgcagttcactctcggctggcatgtgtacttag

SEQ ID NO: 48220 - DNA, 323 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgtcggtctcatcttccactccttcctcctcgtcccttacttctcctggaagtacagtcatcgacgccaccattccaacactggctccctcgagagagacgaagtgtttgtccccaagaagaagtcagacatcaagtggcacggcaagtacctcaacaaccctttgggacgcaccgtgatgttaacggttcagttcactctcggctggcctttgtacttag

SEQ ID NO: 48221 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48222 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctgtgtacttag

SEQ ID NO: 48223 - DNA, 358 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacgtttcatgtcactatcggctggcctgtgtacttag

SEQ ID NO: 48224 - DNA, 401 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccatcgccagccacgatggcggcaaacagccgctggacaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48225 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48226 - DNA, 435 bp, Artificial
  Mutation in BnaC.FAD2.a introduced by TALE nuclease pair BnFAD2_T05
cctctcctccctcaccctctcccttacctcgcctggcccctctactgagcctgccaaggctgcgtcctaacgggcctctgggtcattgcccacgaatgccaggcccacggcttgaccccggagcaggtggtggccatcgctagccacgatggcggcaagcaggcgctggcgaccgccaccacgccttcagcgactaccagtggcttgacgacaccgtcggtctcatcttccactacttcctcctcgtcccttacttctcctggaagtacagtcatcgacgccaccattccaacactggctccctcgagagagacgaagtgtttgtccccaagaagaagtcagacatcaagtggtacggcaagtacctcagcatccctttgggacgcaccgtgatgttaaggggacagttcactctcggctggcctttgtacttag

SEQ ID NO: 48227 - DNA, 356 bp, Artificial
  Mutation in BnaC.FAD2.a introduced by TALE nuclease pair BnFAD2_T05
cctcttctccctcaccctctctcctacttcgcctggcctctctactgagcctgccaaaggcgcgtcctaaccggcgtctgggtcatagcccacgagtcaccacgccttcagcgactaccagtggcttgacgccaccgtcggtctcatcttccactccttcctcctcgtcccttacttctcctggaagtacaatcatcgacgccaccattccaacactggctccctcgagagagactaagtgtttgtccccaagaagaagtcagacatcaagtggtacggcaagtacctcaacaaccctgtgggccgccccgggattttaacggtgcaggtcactctcggctggccttagtacttag

SEQ ID NO: 48228 - DNA, 471 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggctggaccgtctccagcgcctgcttgccaccatcgtggctggcgatggccaccacctgctccggggtcaagccgtgggcctggcacagcaccggcaacagccgctggagacgaaccacgccttcagcgactaccagtggcttgacgacaccgtcggtctcaccttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48229 - DNA, 357 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48230 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48231 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48232 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48233 - DNA, 401 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccatcgccagccacgatggcggcaaacagccgctggacaccaccacgcattcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48234 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtacagttcactctcggctggcctttgtacttag

SEQ ID NO: 48235 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 48236 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatattaacggttcagttcactctcggctggcctttgtacttag

SEQ ID NO: 48237 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48238 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacataaagtggtacggcaagtacctcaacaaccctttgggacgcaccgtgatgttaacggttcagttcactctcggctggcctttgtacttag

SEQ ID NO: 48239 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48240 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgttaacggttcagttcactctcggctggcctttgtacttag

SEQ ID NO: 48241 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48242 - DNA, 358 bp, Artificial
  Mutation in BnaC.FAD2.a introduced by TALE nuclease pair BnFAD2_T05
cctctgctccctcaccctctctcctacttcgcctggcatgtctactgggcctgccaagggtgcgtcctaaccggcgtctgggtcatagcccacgagtgccaccacgccttcagcgactaccagttgcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48243 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcctagcccacgagtgctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48244 - DNA, 361 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggctggaccgtctccagcgactaccagcggctagacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 48245 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 48246 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48247 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48248 - DNA, 419 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggtatcttcgagccagccacgatcgacattgatctggcacagcaccggatggtttgactccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48249 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgccctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccaggatgttaacggttcagttcactcccggctggcctttgtacttag

SEQ ID NO: 48250 - DNA, 407 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccattgctggcgatggccaccacctgctggggggtcaagccgtgggcctggcacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48251 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48252 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaggaagaagtcagacatcaagtggtacggcaagtacctcaacaaccctttgggacgcaccgtgatgttaacggttcagttcactctcggctggcctttgtacttag

SEQ ID NO: 48253 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48254 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaacaacaccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48255 - DNA, 362 bp, Artificial
  Mutation in BnaC.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48256 - DNA, 355 bp, Artificial
  Mutation in BnaC.FAD2.a introduced by TALE nuclease pair BnFAD2_T05
cctctcctccctcaccctgtctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttttacttag

SEQ ID NO: 48257 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 48258 - DNA, 361 bp, Artificial
  Mutation in BnaC.FAD2.a introduced by TALE nuclease pair BnFAD2_T05
ccttcctccctcaccctctctcctacttcgcctggcctctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48259 - DNA, 342 bp, Artificial
  Mutation in BnaC.FAD2.a introduced by TALE nuclease pair BnFAD2_T05
cctctcctccctcaccctctctactacttcgcctggcctctctactgggcctgccaagggtgcgtcctaaccggcgtctgggtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48260 - DNA, 359 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgcacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgcgcggctggcctttgtacttag

SEQ ID NO: 48261 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaaggctgcgtcctaaccggcgtctgggtcatagcccacggccaccacgacttcagcgactaccactggcttgaccacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48262 - DNA, 395 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaacagccgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48263 - DNA, 401 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccatcgccagccacgatggcggcaaacagccgctggacaccaccacgccttcagcgactaccagtagcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48264 - DNA, 460 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgatgttacgcagcagggcagtcgccctaaaacaaagttaaacattatgagggaagcggtgatcgccgaagtatcgactcaactatcagaggtagttggccaccacgccttcagcgcctaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacgcttcagttcactctcggctggcctttgtacttag

SEQ ID NO: 48265 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 48266 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48267 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48268 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 48269 - DNA, 435 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48270 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 48271 - DNA, 403 bp, Artificial
  Mutation in BnaC.FAD2.a introduced by TALE nuclease pair BnFAD2_T05
cctctcctccctcaccctttctcctacttcgcctggccactctcctgggcctgccaagggtgcgtcctaaccggcgtctgggtcatagcccacgagtgtcgggtttcgccacctctggtggtggccatcgccagcaatggcggtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactcgcggctggcctttgtacttag

SEQ ID NO: 48272 - DNA, 357 bp, Artificial
  Mutation in BnaC.FAD2.a introduced by TALE nuclease pair BnFAD2_T05
cctctcctccctcaccctctctcctacttcgcctcgcctctctactgggcctgccaagggtgcgtcctaaccggcgtctgggtcatagcccacgagtgcagccccccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48273 - DNA, 358 bp, Artificial
  Mutation in BnaC.FAD2.a introduced by TALE nuclease pair BnFAD2_T05
cctctcctccctcaccctctcccttacctcgcctggccactctactgggcctgccaaggctgcgtcctaacgggcctctgggtcatcgcccacgaatgcgaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48274 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48275 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaaggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48276 - DNA, 358 bp, Artificial
  Mutation in BnaC.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48277 - DNA, 363 bp, Artificial
  Mutation in BnaC.FAD2.a introduced by TALE nuclease pair BnFAD2_T05
cctctcctccctcaccctctctcctacttcgcctggcctctctactgcgcctgccaagtgtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48278 - DNA, 407 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgccattgctggcgatggccaccacctgctggggggtcaagccgtgggcctggcacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48279 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48280 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 48281 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48282 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgcacttag

SEQ ID NO: 48283 - DNA, 359 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccccaacaacccttcgggacgccccgtgatgttaacggttcagttcactctcgcctggcctttggaattag

SEQ ID NO: 48284 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48285 - DNA, 322 bp, Artificial
  Mutation in BnaC.FAD2.a introduced by TALE nuclease pair BnFAD2_T05
ctctcctccctcaccctctctcctacttcgcctggcctctctactgggcctgccaagggtgcgtcctaaccggcgtctgggtcatagcccacgagtgcggccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48286 - DNA, 392 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcccaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagtcatcgacgccaccatcccaacactcgctccctcgagagagacgatgtgtttgcccccaagaagaagtcagacatcaagtggcaccgcaagtcgctgaacaagccttaggaacgccccgtgatgttaacggttcagttcactctcggctggcctttgtacttag

SEQ ID NO: 48287 - DNA, 471 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctggggggtcaagccgtgggcctggcacagcaccggcaacagcgcaatgacattcttgcaggtatggccaccacctggggggtcaagccgtgggcctggcacagcaccggcaacagccgctggaccgtctccagcgcctgcttgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48288 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 48289 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 48290 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48291 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48292 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48293 - DNA, 407 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccattgctggcgatggccaccacctgctggggggtcaagccgtgggcctggcacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 48294 - DNA, 359 bp, Artificial
  Mutation in BnaC.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggcaagtacctcaacaaccctttgggacgcaccgtgatgttaactgttcagttcactctcggctggcctttgtacttag

SEQ ID NO: 48295 - DNA, 403 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcgggtttcgccacctctggtggtggccatcgccagcaatggcggtgaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48296 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 48297 - DNA, 435 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggcttgacgacaccgtcggtctcatcttccactccttcctcctcgtcccttacttctcctggaagtacagtcatcgacgccaccattccaacacgggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 48298 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48299 - DNA, 358 bp, Artificial
  Mutation in BnaC.FAD2.a introduced by TALE nuclease pair BnFAD2_T05
cctctcctccctcaccctctctcctacttcgcctggcccctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcacgctcggctggcctttgtacttag

SEQ ID NO: 48300 - DNA, 460 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgatgttacgcagcagggcagtcgccctaaaacaaagttaaacattatgagggaagcggtgatcgccgaagtatcgactcaactatcagaggtagttggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcccgctcggctggcctttgtacttag

SEQ ID NO: 48301 - DNA, 460 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgatgttacgcagcagggcagtcgccctaaaacaaagttaaacattatgagggaagcggtgatcgccgaagtatcgactcaactatcagaggtagttggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48302 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48303 - DNA, 467 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccatcgccagcaatattggtggcaagcaggcgctggagacggtccaggcgctgttgccggtgctgtgccaggcccacggcttgaccccccagcaggtggtggccatccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48304 - DNA, 346 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgccttcagcgactaccagtggcttaacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48305 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 48306 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgaccccaagaagaagtcagacatcaagtggtacggcaagtacctcaacaaccctttgggacgcaccgtgatgttaacggttcagttcactctcggctggcctttgtacttag

SEQ ID NO: 48307 - DNA, 331 bp, Artificial
  Mutation in BnaC.FAD2.a introduced by TALE nuclease pair BnFAD2_T05
cctctcctccctcaccctctctcctacttcgcctggcatctctcctgggcctgccaagggtgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48308 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggctttacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48309 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48310 - DNA, 360 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 48311 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48312 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcaggtcactctcggctggcctttgtacttag

SEQ ID NO: 48313 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48314 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccaatccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48315 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctgtgtacttag

SEQ ID NO: 48316 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcggcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48317 - DNA, 359 bp, Artificial
  Mutation in BnaC.FAD2.a introduced by TALE nuclease pair BnFAD2_T05
cctctcctccctcaccctctctcctacttcgcctggccactctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggtgcaggtcactctcggctggcctttgtacttag

SEQ ID NO: 48318 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacgtttcagttcactctcggctggcctttgtacttag

SEQ ID NO: 48319 - DNA, 331 bp, Artificial
  Mutation in BnaC.FAD2.a introduced by TALE nuclease pair BnFAD2_T05
cctctcctccctcaccctctctcctacttcgcctcgcctctctactgggcctgccaagggtgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48320 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48321 - DNA, 357 bp, Artificial
  Mutation in BnaC.FAD2.a introduced by TALE nuclease pair BnFAD2_T05
cccctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48322 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 48323 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacatccctttgagacgcaccgtgatgttaaccgttcggttcactctcggctggcctttgtacttag

SEQ ID NO: 48324 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48325 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48326 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcctagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctaaacaaccctttgggacgcaccgtgatgttaacggttcagttcactctcggctggcctttgtacttag

SEQ ID NO: 48327 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48328 - DNA, 348 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctatcttccactccttcctcctcgtcccttacttctcctggaagtacagtcatcgacgccaccattccaacactggctccctcgagagagacgaagtgtttgtccccaagaagaaatcagacatcaagtggtacggcaagtacctcaacagccctttgttacgcaccgtgatggtaacggttcagttcactctcggcttgccgttgtacttag

SEQ ID NO: 48329 - DNA, 362 bp, Artificial
  Mutation in BnaC.FAD2.a introduced by TALE nuclease pair BnFAD2_T05
cctctctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcatttgtacgtag

SEQ ID NO: 48330 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggaaagtacctcaacaacccgctaggacgcacggtgatgctaaccgtccagttcactctcggctggcctttgtacttag

SEQ ID NO: 48331 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 48332 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccatggctgcgtcctaaccggcgtctgggtcatagcccaccacgctttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48333 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48334 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttggtacgcaccgtgatgttaacggttcagttcactctcggctggcctttgtactag

SEQ ID NO: 48335 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggattgacgacaccgtcggtctcatcttccactccatcctcctcgtcccttacttctcctggaagtacagtcatcgacgccaccattccaacactggctccctcgagagagacgaagtgtatgtccccaagaagaagtcagacatcaagtggtacgacaagtacctcagcaaccctttgggacgcaccgtgatgttaacggttcagttcactctcggctggcatttgtactcag

SEQ ID NO: 48336 - DNA, 344 bp, Artificial
  Mutation in BnaC.FAD2.a introduced by TALE nuclease pair BnFAD2_T05
cctctcctccctcaccctctctcctacttcgcctggcatctctcctgagcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 48337 - DNA, 394 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcattgctcatcaatttgttgcaacgaacaggtcactatccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48338 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacgaccctgtgggacgcaccgtgatgttaacggttcagttcactctcggctggcctttgtacttag

SEQ ID NO: 48339 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48340 - DNA, 348 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48341 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48342 - DNA, 357 bp, Artificial
  Mutation in BnaC.FAD2.a introduced by TALE nuclease pair BnFAD2_T05
cctctctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48343 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48344 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaaggctgcgtcctaaccggcgtctgggtcatcgcccacgagacccgttcagcgaccaccagtggcttgacgacgccggcggtctcctcttccactccttcctcctcgtcccttacttctcctggaagtacaggcatcgacgccaccattccaacactggctccctcgagagagacgaagtgtttgtccccaagaagaagtcagacatcaagtggtacggcaagtacctcaacaaccctgtgggacgcacggtgatgttaaccgttcagttcactctcggctggcctttgtacttag

SEQ ID NO: 48345 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggcttgacgacaccgtcggtctcatcttccactccttcctcctcgtcccttacttctcctggaagtacagtcatcgacgccaccattccaacactggctccctcgagagagacgaagtctttgtccccaagaagaagtcagacatcaagtggtacggcaagtacctcaacaaccctttgggacgcaccgtgatgttaacggttcagttcactctcggctggcctttgtacttag

SEQ ID NO: 48346 - DNA, 396 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtggtggccatcgccagcaatggcggtggcaagcaggcgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48347 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggcctcatcttccactccttcctcctcgtcccttacttctcctggaagtacagtcatcgacgccaccattccaaaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48348 - DNA, 279 bp, Artificial
  Mutation in BnaC.FAD2.a introduced by TALE nuclease pair BnFAD2_T05
cctccctccctcaccctctctcctacttcgcctggcctctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 48349 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 48350 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagccatcgacgccaccattccaaaaccggatccctcgagagagacgaagtgtttgaccccaagaagaagtcagacatcaagtggtacggcaagtacctcaacaaccctgtgggacgcaccgtgatgttaacggttcagttcactctcggctggcctttgtactgag

SEQ ID NO: 48351 - DNA, 468 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccccctgtagccgtacaccttcatgaagaactccatcaccttcatctccaagcagcaagcgcgttacgccgtggaacagcaacggcccggagggtggcgggcgtgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48352 - DNA, 357 bp, Artificial
  Mutation in BnaC.FAD2.a introduced by TALE nuclease pair BnFAD2_T05
ccttcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48353 - DNA, 358 bp, Artificial
  Mutation in BnaC.FAD2.a introduced by TALE nuclease pair BnFAD2_T05
cctctcctccctcaccatctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48354 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 48355 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48356 - DNA, 396 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaagcaggcgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48357 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggtaagtacctcaacaaccctttgggacgcaccgtgatgttaacggttcagttcacgctcggctggcctttgtacttag

SEQ ID NO: 48358 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtaccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48359 - DNA, 349 bp, Artificial
  Mutation in BnaC.FAD2.a introduced by TALE nuclease pair BnFAD2_T05
cctctcctccctcaccctctctcctacttcgcctggtctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48360 - DNA, 319 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48361 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccccgccttcagcgactaccagtggcttgacgccaccgtcggtctcatcttccactccttcctcctcgtcccttacttctcctggaagtacagtcatcgacgccaccattccaacactggctccctcgagagagacgaagtgtttgtccccaagaagaagtcagacatcaagtgttacggcaagtacctcaacaaccgtttgggacgcaccgtggtgttaaccgttcaattcacgctcggctggcctcagtacttag

SEQ ID NO: 48362 - DNA, 364 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48363 - DNA, 359 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48364 - DNA, 358 bp, Artificial
  Mutation in BnaC.FAD2.a introduced by TALE nuclease pair BnFAD2_T05
cctctcctcctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48365 - DNA, 357 bp, Artificial
  Mutation in BnaC.FAD2.a introduced by TALE nuclease pair BnFAD2_T05
ctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattacaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48366 - DNA, 349 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48367 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48368 - DNA, 357 bp, Artificial
  Mutation in BnaC.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48369 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48370 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccgccgtctgggtcatagcccaccacgccttcaccgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacactcggctggcctttgtacttag

SEQ ID NO: 48371 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcactgtgatgctaaccgtccagttcacgctcggctggcctttgtacttag

SEQ ID NO: 48372 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccctaagaagaagtcagacatcaagtggtacggcaagtacctcaacaaccctttgggacgcaccgtgatgttaacggttcagttcactctcggctggcctttgtacttag

SEQ ID NO: 48373 - DNA, 340 bp, Artificial
  Mutation in BnaC.FAD2.a introduced by TALE nuclease pair BnFAD2_T05
cctctcctccctcaccctctctcctacttcgcctggactctctactgggcctgccaagggtgcgtcctaaccggcgtctgggtcctagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 48374 - DNA, 349 bp, Artificial
  Mutation in BnaC.FAD2.a introduced by TALE nuclease pair BnFAD2_T05
cctctcctccctcaccctctcacttacctcgcctggcccctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctgggacgcaccgtgatgttaacggttcagttcactttcggctggcctttgtacttag

SEQ ID NO: 48375 - DNA, 319 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48376 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgaggctaaccgtccagttcacgctcggctggccgttgtacttag

SEQ ID NO: 48377 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacaccggatcactcgagagggatgaagtgttcgtccccaagaagaaatccgacatcaagtggtacggaaagtacctcaacaacccgctaggacgcacggtgatgctaaccgtccagtgcacgctcggctggccgtggtacttag

SEQ ID NO: 48378 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgactacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48379 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcgccgtgaggttaacggttcagttcactctcggctggccgtggtacttag

SEQ ID NO: 48380 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgttgggacgcaccgtgatgttaacggttcagttcactctcggctggcctttgtacttag

SEQ ID NO: 48381 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48382 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggctcgacgacaccgtcgatctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctgtgtacttag

SEQ ID NO: 48383 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48384 - DNA, 357 bp, Artificial
  Mutation in BnaC.FAD2.a introduced by TALE nuclease pair BnFAD2_T05
cctctcctccctcaccctttctcctacttcgcctggcctctctactgggcctgccaagggcgcgtcctaaccggcgtctgtgtcatagcccacgagtgcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48385 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48386 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 48387 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcacgctcggctggcctttgtacttag

SEQ ID NO: 48388 - DNA, 419 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggtatcttcgagccagccacgatcgacattgatctggcacagcaccggatggtttgactccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48389 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48390 - DNA, 361 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtcttag

SEQ ID NO: 48391 - DNA, 435 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48392 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctactggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48393 - DNA, 357 bp, Artificial
  Mutation in BnaC.FAD2.a introduced by TALE nuclease pair BnFAD2_T05
cctctcctccctcaccctctctcctacttcgcctagcctctctactgggcctgccaagggtgcgtcctcaccggcgtctgggtcatcgcccacgagtgcaccacgccttcagcgactaccagtggcttgacgacaccgtcggtctcctcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 48394 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 48395 - DNA, 357 bp, Artificial
  Mutation in BnaC.FAD2.a introduced by TALE nuclease pair BnFAD2_T05
cctctcctccctcaccctctctcctacttcgcctggcctctctactcggcctgccaagggagcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtccctcaacaaccctgtgggacgcacggggcagttaacggttcagttcactctcggctggcctttgtacttag

SEQ ID NO: 48396 - DNA, 407 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccattgctggcgatggccaccacctgctggggggtcaagccgtgggcctggcacacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48397 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacatag

SEQ ID NO: 48398 - DNA, 355 bp, Artificial
  Mutation in BnaC.FAD2.a introduced by TALE nuclease pair BnFAD2_T05
cctctcctccctcaccctctctcctacttcgcctggcctcactactgggcctgccaagggtgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48399 - DNA, 358 bp, Artificial
  Mutation in BnaC.FAD2.a introduced by TALE nuclease pair BnFAD2_T05
cctctcctccctcaccctctcccttacctcgcctggcccctctactgggcctgcaaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48400 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48401 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48402 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48403 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccctcagcggctaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48404 - DNA, 357 bp, Artificial
  Mutation in BnaC.FAD2.a introduced by TALE nuclease pair BnFAD2_T05
cctctcctccctcaccctctctcctacttcgcctcgcctctctactgcgcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggtcgcaccgtgatgttaacggttcagtgcactctcggctggcattagtacgtag

SEQ ID NO: 48405 - DNA, 345 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 48406 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccttagtacttag

SEQ ID NO: 48407 - DNA, 331 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48408 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcattgcccacgagtgctaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaatcacctcaacaacccgctaggacgcacggtgaggctaaccgtccagttcaggctcggctggccttagtacttag

SEQ ID NO: 48409 - DNA, 345 bp, Artificial
  Mutation in BnaC.FAD2.a introduced by TALE nuclease pair BnFAD2_T05
cctctcctccctcaccctctctcctacttcgcctggcctctctactgggcctgccagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48410 - DNA, 343 bp, Artificial
  Mutation in BnaC.FAD2.a introduced by TALE nuclease pair BnFAD2_T05
cctctcctccctcaccctctctcctacttcgcctggcctctctactgggcctggcacagcaccggcaagcaggcgctggagacgaaccacgccttcagcgactaccagtggcttgacgacaccgtcggtctcatcttccactccttcctcctcgtcccttacttctcctggaagtacagtcatcgacgccaccattccaacactggctccctctagagagacgaagtgtttgtccccaagaagaagtcagacatcaagtggtacggcaagtacctcaacaaccctttgggacgcaccgtgatgttaacgggtcagttcactctcggctggcctgtgtacttag

SEQ ID NO: 48411 - DNA, 379 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgagcctttcgttttatttgatgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48412 - DNA, 279 bp, Artificial
  Mutation in BnaC.FAD2.a introduced by TALE nuclease pair BnFAD2_T05
ccttcctccctcaccctctctcctacttcgcctggcctctctactgggcctgccaagggtgcgtcctaaccggccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 48413 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48414 - DNA, 398 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcgggtttcggcaggtggtggccatcgccagcaatggcggtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48415 - DNA, 345 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 48416 - DNA, 280 bp, Artificial
  Mutation in BnaC.FAD2.a introduced by TALE nuclease pair BnFAD2_T05
cctctcctccctcaccctctctcctacttcacctggcctctctactgagcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48417 - DNA, 280 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48418 - DNA, 360 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 48419 - DNA, 359 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48420 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactatcggctggcctttgtacttag

SEQ ID NO: 48421 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaacaggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48422 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttggtacgcaccgtgatgttaacggttcagttcactctcggctggcctttgtacttag

SEQ ID NO: 48423 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaggaagaagtcagacatcaagtggtacggcaagtacctcaacaaccctttgggacgcaccgtgatgttaacggttcagttcactctcggctggcctttgtacttag

SEQ ID NO: 48424 - DNA, 331 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48425 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48426 - DNA, 402 bp, Artificial
  Mutation in BnaC.FAD2.a introduced by TALE nuclease pair BnFAD2_T05
ccttcctccctcaccctctctcctacttcgcctggcctctctactgggcctgccaagggtgcgtcctaaccggcgtctgggtcatagcccacgagtgtcgggtttcgccacctctggtggtggccatcgccagcaatggcggtgaccacgccttcagcgactaccagtggcttgacgacaccgtcggtctcatcttccactccttcctcctcctcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48427 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48428 - DNA, 359 bp, Artificial
  Mutation in BnaC.FAD2.a introduced by TALE nuclease pair BnFAD2_T05
cctctcatccctcaccctctctcctacttcgcctggcctctctactgggcctgccaagggtgcgtcctaaccggcgtctgggtcatagcccacgagtgcccaccacgccttcagcgactaccagtggcttgacgacaccatcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48429 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggcttgacgacaccgtcggtctcatcttccactccttcctcctcgtcccttacttctcctggaagtacagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48430 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48431 - DNA, 395 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggaggcaacagccgctggaccaccccttcagcgactaccagtggcttgacgacaccgtcggtctcatcttcccctccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48432 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 48433 - DNA, 394 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaaaagcattgctcatcaatttgttgcaacgaacaggtcactatccaccacgccttcagcgactaccagtggcttgacgacaccgtcggtctcatcttccactccttcctcctcgtcccttacttctccttgaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48434 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48435 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48436 - DNA, 398 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcgggtttcggcaggtggtggccatcgccagcaatggcggtgaccacgccctcagcgactaccagtggcttgacgacaccgtcggtctcatcttccaccccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48437 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48438 - DNA, 356 bp, Artificial
  Mutation in BnaC.FAD2.a introduced by TALE nuclease pair BnFAD2_T05
cctctcctccctcaccctctcccttacctcgtctggccactctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtccggcaagtaccccaacaccccagttgtacgcacggggatgttaccccttcagctccctctcggctggcctttgtacttag

SEQ ID NO: 48439 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48440 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48441 - DNA, 353 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgcaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48442 - DNA, 358 bp, Artificial
  Mutation in BnaC.FAD2.a introduced by TALE nuclease pair BnFAD2_T05
cctctcctccctcaccctctctcctacttcgcctggcctctttactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48443 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48444 - DNA, 360 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48445 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgttcccaagaagaagtcagacatcaagtggtacggcaagtacctcaacaaccctttgggacgcgccgtgatgttaacggttcagttcactctcggctggcctttgtacttag

SEQ ID NO: 48446 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagcacagtcatcgacgccaccattccaacactggctccctcgagagagacgaagtgtttgtccccaagcagcagccagacatcaagtggtacggcaagtacctcaacaacccttcgggacgcaccgtgatgttaaccgttcagttcactctcggctggcctttgtacttag

SEQ ID NO: 48447 - DNA, 358 bp, Artificial
  Mutation in BnaC.FAD2.a introduced by TALE nuclease pair BnFAD2_T05
cctctcctccctcaccctctctcctacttcgcctggcctctctactggtcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48448 - DNA, 354 bp, Artificial
  Mutation in BnaC.FAD2.a introduced by TALE nuclease pair BnFAD2_T05
cctctcctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48449 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttttgtacttag

SEQ ID NO: 48450 - DNA, 360 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48451 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48452 - DNA, 358 bp, Artificial
  Mutation in BnaC.FAD2.a introduced by TALE nuclease pair BnFAD2_T05
cctctcctccctcaccctctctcctacttctcctggcctctctactcggcctcccaagggcgcgtcctcaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtcgttcgccaagtcgcccaacacgcctgatggacgcaagatgatgcttaccgtcccgctccctctcggctggcctttgtacttag

SEQ ID NO: 48453 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaagcgtccagttcacgctcggccggcctttgtacttag

SEQ ID NO: 48454 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48455 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccttcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 48456 - DNA, 462 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgactccagcgcctgcttgccgccatcgtggctccgccaccctccgggccgttgcttcacaacgttcaaatccgctcccggcggatttgtcctactcaggagagcgtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48457 - DNA, 395 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccacacagtgatattgattttctggttacggtgaccaccacgccttcatcgactcccagtgtcttgacgacaccgtccgtctcatcttccactccttcctcctcgtcccttacttctccttgaagtacactcatcgacgccaccattccatcacttgctccctcgagagggatgaagtgttcgtccccaagatgaaatcccacatcaactggtacggcaagtacctcaacatccttctgggacgcaccgtgatgttaccggtgcagttcactcccggctggcctttgtactgag

SEQ ID NO: 48458 - DNA, 349 bp, Artificial
  Mutation in BnaC.FAD2.a introduced by TALE nuclease pair BnFAD2_T05
cctctcctccctcaccctctcccttacctcgcctggcctctctactgggcctgccaagggtgcgccctaaccggcgtctgggtcatagcccacgagtgatgatggaagtaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcgccgtgatgttaacggatcagttcactctcggctggcctttgtacttag

SEQ ID NO: 48459 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48460 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48461 - DNA, 323 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48462 - DNA, 364 bp, Artificial
  Mutation in BnaC.FAD2.a introduced by TALE nuclease pair BnFAD2_T05
cctctcctccctcaccctctcccttacctcgcctggcctctctactcggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48463 - DNA, 357 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcaccacgccttcagcgactaccagtggcttgacgacgccgtcggtctcaccttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48464 - DNA, 398 bp, Artificial
  Mutation in BnaC.FAD2.a introduced by TALE nuclease pair BnFAD2_T05
cctctcctccctcaccctctctcctacttcgcctggcctctctactgggcctgccaatggtgcgtcctaaccggcgtctgggtcatagcccacgagtgtcgggtttcggcaggtggtggccatcgccagcaatggcggggaccacgccttcagcgtctaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48465 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaaccacgccttcagcgactaccatgggcttgacgacaccgtcgggctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaccaaccctttgggacgcaccgtgatgttaacggttcagttcactctcggctggactttgtacttag

SEQ ID NO: 48466 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48467 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctttgtacttag

SEQ ID NO: 48468 - DNA, 358 bp, Artificial
  Mutation in BnaC.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48469 - DNA, 401 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccatcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccttttgggacgcaccgtgatgttaacggtgcagttcactttcggctgccctttgtacgtag

SEQ ID NO: 48470 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccaggggcttgacgacaccgtcggtctcatcttccactccttcctcctcgtcccttacttctcctggaagtacagccatcgacgccaccattccaacaccggatccctcgagagggatgaagtgttcgtccccaagaagaaatccgccatcaagtggtacggaaagtacctcaccaacccgctaggacgcacggtgatgctaaccgtccagttcacgctcggctggcctttgtacttag

SEQ ID NO: 48471 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48472 - DNA, 280 bp, Artificial
  Mutation in BnaC.FAD2.a introduced by TALE nuclease pair BnFAD2_T05
cctctcctccctcaccctctctactacttcgcctggcctatctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48473 - DNA, 348 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgactaccatttgcttgacgacaccgtcggtctcatcttccactccttcctcctcgtcccttacttctcctggaagtacagtcatcgactccaccattccaacactggctccctcgagagagacgaagtgtttgtccccaagaagaagtcagacatcaagtggtacggcaagtacctcaacacccctttgggacgcaccgtgatgttaaccgttcagttcactctcggctggcctttgtacttag

SEQ ID NO: 48474 - DNA, 362 bp, Artificial
  Mutation in BnaC.FAD2.a introduced by TALE nuclease pair BnFAD2_T05
cctctcctccctcaccctgtctcctacttcgcctggcctctctactgagcctgccaagggtgcgtcctaaccggcgtctgggtcatagcccacgagtgcgggccaccacgccttcagcgactaccagtgccttgacgacaccgtcggtctcatcttcccctccttcctcctcgtcccttacttctcctggaagtacagtcatcgacgccaccactccaacactggctccctcgagagagacgaagtgtttgtccccaagaagaagtcagacatcaagtggttcggcaagttcctcagcatccgttttagacggagcgtgggggtaaccgtacagttcactctcggctgccctttgtgcttag

SEQ ID NO: 48475 - DNA, 360 bp, Artificial
  Mutation in BnaC.FAD2.a introduced by TALE nuclease pair BnFAD2_T05
cctctcctccctcaccatctctcctacttcgcctggcctctctactgggcctgccaagggtgcgtcccaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48476 - DNA, 403 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcgggtttcgccacctctggtggtggccatcgccagcaatggcggtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 48477 - DNA, 392 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 48478 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgttaacggttcagttcactctcggctggcctttgtacttag

SEQ ID NO: 48479 - DNA, 344 bp, Artificial
  Mutation in BnaC.FAD2.a introduced by TALE nuclease pair BnFAD2_T05
cctctcctccctcactctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 48480 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 48481 - DNA, 407 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccattgctggcgatggccaccacctgctggggggtcaagccgtgggcctggcacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48482 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48483 - DNA, 343 bp, Artificial
  Mutation in BnaC.FAD2.a introduced by TALE nuclease pair BnFAD2_T05
ctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48484 - DNA, 362 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgcgtgcgaccacgccttcagcgactaccagtggcttgacgacaccgtcggtctcatcttccactccttcctcctcgtcccttacttctcctggaagtacagtaatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48485 - DNA, 352 bp, Artificial
  Mutation in BnaC.FAD2.a introduced by TALE nuclease pair BnFAD2_T05
cctctcctccctcaccctctctactacttcgcctggcctctctactgggcctgccaagggtgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcagcgtgatgttaacggttcagttcactctcggctggcctttgtacttag

SEQ ID NO: 48486 - DNA, 355 bp, Artificial
  Mutation in BnaC.FAD2.a introduced by TALE nuclease pair BnFAD2_T05
cctcttctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcagcatccctttgggacgcaccgtgatgttaacggttcaattcacgctcggctggcctttgtacttag

SEQ ID NO: 48487 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48488 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48489 - DNA, 358 bp, Artificial
  Mutation in BnaC.FAD2.a introduced by TALE nuclease pair BnFAD2_T05
cctctcttccctcaccctctctcctacttcgccttgcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 48490 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 48491 - DNA, 352 bp, Artificial
  Mutation in BnaC.FAD2.a introduced by TALE nuclease pair BnFAD2_T05
cctctcctccctcaccctatctcctacttcgcctggcctctctactgggcctgccaagggcgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacgacaagtccctaaacacccctttggaaagcaccgtgatgttaacggttcagttcactctcggctggcctttgtacttag

SEQ ID NO: 48492 - DNA, 358 bp, Artificial
  Mutation in BnaC.FAD2.a introduced by TALE nuclease pair BnFAD2_T05
cctctcctccctcaccctctctcctacttcgtcctgcctcgctactgggcctgccaagggtgcgccctaaccggcctctgggtcatagcccacgagtgccaccacgccttcaccgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtacgtaaagtacctcaacaacccgctagggcgcacggtgatcctcctcgccccgttcacgctcggctggcctttgtacttag

SEQ ID NO: 48493 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 48494 - DNA, 355 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48495 - DNA, 395 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaacagccgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 48496 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48497 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcatcgtgatgttaacggttcagttcactctcggctggcctttgtacttag

SEQ ID NO: 48498 - DNA, 360 bp, Artificial
  Mutation in BnaC.FAD2.a introduced by TALE nuclease pair BnFAD2_T05
cctctactcactcaccctctcccttacctcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48499 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcactgtgatgctaaccgtccagttcacgctcggctggcctttgtacttag

SEQ ID NO: 48500 - DNA, 467 bp, Artificial
  Mutation in BnaC.FAD2.a introduced by TALE nuclease pair BnFAD2_T05
cctctcctccctcaccctctctcctacttcgcctcgcctctctactgggcctgccaagggtgcgtcataaccggcgtctgggtcatagcccacgagtgcggccatcgccagcaatattggtggcaagcaggcgctggagacggtccaggcgctgttgccggtgctgtgccaggcccacggcttgaccccccagcaggtggtggccatccaccaccccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 48501 - DNA, 355 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48502 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48503 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48504 - DNA, 360 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48505 - DNA, 462 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgactccagcgcctgcttgcctccatcgtggctccgccaccctccgggccgttgcttcacaacgttcaaatccgctcccggcggatttgtcctactcaggagagcgtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48506 - DNA, 328 bp, Artificial
  Mutation in BnaC.FAD2.a introduced by TALE nuclease pair BnFAD2_T05
cctctcctccctcaccctgtctcctacttcgcctggcctctctactgggcctgccaagggtgcgtcctaaccggcgtctgggtcatcgcccacgagtgcgacgacaccgtcggtctcatcttccactccttcctcctcgtcccttacttctcctggaagtacagtcatcgacgccaccattccaacactggctccctcgagagaaacgaagtgtttgtccccaagaagaagtcagacatcaagtggtacggcaagtacctcaacaaccctttgggacgcaccgtgatgttaacggttcagttcactctcggctggcctttttacttag

SEQ ID NO: 48507 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagggactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttcgtacttag

SEQ ID NO: 48508 - DNA, 394 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcattgctcatcaatttgttgcaacgaacaggtcactatccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggcctttgtacttag

SEQ ID NO: 48509 - DNA, 354 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48510 - DNA, 362 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48511 - DNA, 358 bp, Artificial
  Mutation in BnaC.FAD2.a introduced by TALE nuclease pair BnFAD2_T05
cctttcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48512 - DNA, 361 bp, Artificial
  Mutation in BnaC.FAD2.a introduced by TALE nuclease pair BnFAD2_T05
ccttcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48513 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48514 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 48515 - DNA, 329 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48516 - DNA, 361 bp, Artificial
  Mutation in BnaC.FAD2.a introduced by TALE nuclease pair BnFAD2_T05
cctctctccctcaccctatctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagccatcgacgacaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48517 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcaacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48518 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 48519 - DNA, 348 bp, Artificial
  Mutation in BnaC.FAD2.a introduced by TALE nuclease pair BnFAD2_T05
cctctcctccctcaccctctctcctacttcgcccggcctctctactgggcctgccaagggtgcgtcctaaccggcgtctgggtcatagcccacgagtgttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48520 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctggcctttgtacttag

SEQ ID NO: 48521 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgttaacggttcagttcactctcggctggcctttgtacttag

SEQ ID NO: 48522 - DNA, 419 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggtatcttcgagccagccacgatcgacattgatctggcacagcaccggatggtttgacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48523 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48524 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48525 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccacacgccttcagggactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 48526 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaaggggtacggcaagtacctcaacaaccctttgggacgcaccgtgatgttaacggttcagttcactctcggctggcctttgtacttag

SEQ ID NO: 48527 - DNA, 358 bp, Artificial
  Mutation in BnaC.FAD2.a introduced by TALE nuclease pair BnFAD2_T05
cctctcctccctcaccctctctcctacttcgcctggcccctctactgggcctgccaaggctgcgtcctaacgggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48528 - DNA, 357 bp, Artificial
  Mutation in BnaC.FAD2.a introduced by TALE nuclease pair BnFAD2_T05
cctctcctccctcaccctctctcctacttcgcctggactctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48529 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 48530 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 48531 - DNA, 363 bp, Artificial
  Mutation in BnaC.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgaatgcggcctcaccacgccttcagcgactaccagtggcttgacgaccccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatcccttttggacgcaccgtgattttaacggttcagttcactctcggctggcctttgtgcttag

SEQ ID NO: 48532 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 48533 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48534 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgactgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagatatcaagtggtacggcaagtaccgcaacagccctttgggacgcaccgtgaggttatcggttcagtgctctctcggctggcctttgtacttag

SEQ ID NO: 48535 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacggcttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 48536 - DNA, 359 bp, Artificial
  Mutation in BnaC.FAD2.a introduced by TALE nuclease pair BnFAD2_T05
cctcacctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 48537 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtccttag

SEQ ID NO: 48538 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgcttgtccccaagaagaagtcagacatcaagtggtacggcaagtacctcaacaaccctttgggacgcaccgtgatgttaacggttcagttcactctcggctggcctttgtacttag

SEQ ID NO: 48539 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48540 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48541 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48542 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48543 - DNA, 348 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48544 - DNA, 355 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtagctcaacatccctttgcgacggaccgtgatgttaacggttcaattcactctcggctggcctttgtacttag

SEQ ID NO: 48545 - DNA, 419 bp, Artificial
  Mutation in BnaC.FAD2.a introduced by TALE nuclease pair BnFAD2_T05
cctctcctccctcaccctctctcctacttcgcctggccactctactgggcctgccaagggtgcgtcctaaccggcgtctgggtcatagcccacgagtgcgggtatcttcgagccagccacgatcgacattgatctggcacagcaccggatggtttgacgacaccacgccttcagcgactaccagtggcttgacgacaccgtcggtctcatcttccactccatcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgggatgttaacggttcagttcactctcggctggccttagtacttag

SEQ ID NO: 48546 - DNA, 358 bp, Artificial
  Mutation in BnaC.FAD2.a introduced by TALE nuclease pair BnFAD2_T05
cctctcctccctcaccctctctcctacttcgcctggcctctctactgggcctaccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48547 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 48548 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 48549 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggcttgacgacaccgtcggtctcatcttccactccttcctcctcgtcccttacttctcctggaagtacagtcatcgacgccacaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48550 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcactctcggctggcctttgtacttag

SEQ ID NO: 48551 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48552 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48553 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggatggcctgagtacttag

SEQ ID NO: 48554 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggtgcagttcactctcggctggcctgtgtacttag

SEQ ID NO: 48555 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48556 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggctcagttcactctcggctggcctttgtacttag

SEQ ID NO: 48557 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 48558 - DNA, 359 bp, Artificial
  Mutation in BnaC.FAD2.a introduced by TALE nuclease pair BnFAD2_T05
cctctcctccctcaccctctctcctgcttcgcctggcccctctactgggcctgccaagggtgcgccctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgaaagagacgaagtgtttgtccccaagaagaagtcagacatcaagtggtacggcaagtccctcaacgaccctgtgggacgcacggtgatgttaacggttccgttcactctcggctggcctttgtacttag

SEQ ID NO: 48559 - DNA, 280 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48560 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggcgcgccctaaccggcgtctgggtcatagcccacgagtgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48561 - DNA, 356 bp, Artificial
  Mutation in BnaC.FAD2.a introduced by TALE nuclease pair BnFAD2_T05
cctctcctccctcaccctctctcctacctcgtctggcctctctactgggattcccaagggcgcgccctaaacggcgtctgggtcatagcccacgagtgaccacgtcttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaggaagtcagacatcaagtggtacggcaagtagctcaacaaccctttggggcgcaccgtgatgttcacggttcagttcactctcggctggcctttgtacttag

SEQ ID NO: 48562 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttttacttag

SEQ ID NO: 48563 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48564 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48565 - DNA, 407 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccattgctggcgatggccaccacctgctggggggtcaagccgttggcctggcacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48566 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccgagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48567 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48568 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaatgtacctcaacaacccgctaggacgcacggtgatcctaaccgtccagttcacgctcggctggcctttgtacttag

SEQ ID NO: 48569 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtcttggtcatagcccacgagacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48570 - DNA, 358 bp, Artificial
  Mutation in BnaC.FAD2.a introduced by TALE nuclease pair BnFAD2_T05
cctcttctccctcaccctctctcctacttcgcctggcctctctactgggcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 48571 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtcttggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48572 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttccgttcactctcggctggcctttgtacttag

SEQ ID NO: 48573 - DNA, 356 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccttgatgttaacggttcagttcactctcgtctggcctttgtacgtag

SEQ ID NO: 48574 - DNA, 355 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48575 - DNA, 346 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48576 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctgccctttgtacttag

SEQ ID NO: 48577 - DNA, 357 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcactctcgtctggcctttgtacttag

SEQ ID NO: 48578 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48579 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48580 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48581 - DNA, 323 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgcggccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48582 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccagcactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48583 - DNA, 357 bp, Artificial
  Mutation in BnaC.FAD2.a introduced by TALE nuclease pair BnFAD2_T05
cctctcctccctcaccctctcacctacttcgcctggcctctctactgctcctgccaaggctgcgtcctaaccggcgtctgggtcatagcccacgagtccaccacgccttcatcgactaccagtggcttgccgacaccgtcggtctcatcttccactccttcctcctcgtcccttacttctcctggaagtacagtcatcgacgccaccattccaacactggctccctcgagagagacgaagtgtttgtccccaagaagaaggcagacatcaagtggtacggcaagtacctcaacaaccctgtgggacgcaccgtgatgttaacggttcagttcacgctcggctggcctttgtacttag

SEQ ID NO: 48584 - DNA, 357 bp, Artificial
  Mutation in BnaC.FAD2.a introduced by TALE nuclease pair BnFAD2_T05
ccttcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48585 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggccatagccaacaagtcccaccacgccttcagcgcctaccagtggcttgacgacaccgtcggtctcatcttccactccttcctccccgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48586 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggcctcatcttccactccttcctcctcgtcccttacttctcctggaagtacagtcatcgacgccaccattccaacaccggatccctcgagagagatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48587 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48588 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctccttgaagtacagtcatcgacgccaccattccaacactggctccctcgagagagacgaagtgtttgtccccaagaagaagtcccacatcaagtggtacggcaagtacctcaacaaccctttgggatgcaccgtgatgttaacggttcagttcactctcggctggcctttgtacttag

SEQ ID NO: 48589 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaataagaaatccgacatcaagtggtacggaaagtacctcaacaacccgctaggacgcacggtgatgctaaccgtccagttcacgctcggctggcctttgtacttag

SEQ ID NO: 48590 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggcttgacgacaccgtcggtctcatcttccactccttcctcctcgtcccttacttctcctggaagtacagtcatcgacgccaccattccaacactgcctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48591 - DNA, 435 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggttgccggtgctgtgccaggcccacggctggaccccggagcaggtggtggccatcgccagccacgatggcggcaagaaccacgccttcagcgactaccagtggcttgacgacaccgtcggtctcatcttccactccttcctcctcgtcccttacttctccttgaagtacagtcatcgacgccaccattccaacactgcctccctcgagagagacgaagtgtttttccccaagaagaagtctcacatcaagtggtacggcaagtacctcaacaaccctttgggacgcaccgtgatgttaacggttcagttcactctcggctggcctttgtacttag

SEQ ID NO: 48592 - DNA, 358 bp, Artificial
  Mutation in BnaC.FAD2.a introduced by TALE nuclease pair BnFAD2_T05
cctctcctccctcaccctctctcctacttcgcctggcatctctactgggcctgccaagggagcgtcctaaccggcgtctgggtcatagcccacgagtgccaccacgccttcagcgactaccagtggcttgacgacaccgtcggtctcatcttccactccttcctcctcgtccattacttctcctggaagtacagtcatcgacgccaccattccaacactggctccctcgagagagacgaagtgtttgtccccaagaagaagtcagacatcaagtggtacggcaagtacctcaacaaccctttgggacgcaccttgatgttaacggttcagttcactctcggctggcctttgtacttag

SEQ ID NO: 48593 - DNA, 358 bp, Artificial
  Mutation in BnaC.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgagtgccaccacgccttcagctactaccagtggcttgacgacaccgtcggtctcatcttccactccttcctcctcgtcccttacttctcctggaagtacagccatcgacgccaccattccaacaccggatccctcgagatggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 48594 - DNA, 358 bp, Artificial
  Mutation in BnaC.FAD2.a introduced by TALE nuclease pair BnFAD2_T05
cctctgctccctcaccctctctcctacttcgcctggcctctctactgggcctgccaagggtgcgtcctaaccggcgtctgggttatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggtgcatttcgctctcggctggcctttgtacttag

SEQ ID NO: 48595 - DNA, 351 bp, Artificial
  Mutation in BnaC.FAD2.a introduced by TALE nuclease pair BnFAD2_T05
cctcttctccctcaccctctctcctacttcgcctggcctctctactgggcctgccaagggagcgtcctaaccggcgtctgggtcatagcccacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48596 - DNA, 345 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48597 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctgtaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48598 - DNA, 349 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaggaagaagtcagacatcaagtggtacggcaagtacctcaacaaccctttgggacgcactgtgattttaacggttcagttcactctcggctggcctttgtacttag

SEQ ID NO: 48599 - DNA, 357 bp, Artificial
  Mutation in BnaC.FAD2.a introduced by TALE nuclease pair BnFAD2_T05
cctctcctccctcaccctctatcctacttcgcctggccactctactgggcctgccaaggacgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatggtaacggttcagttcactctcggctggccgttgtacttag

SEQ ID NO: 48600 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtccctcaacaaccctttgggacgcaccgtgatgttaacggttcagttcactctcggctggcctttgtccttag

SEQ ID NO: 48601 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaaccacgccttcagcgactaccagtggcttgacgacaccgtcggactcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48602 - DNA, 396 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaagccggcgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48603 - DNA, 360 bp, Artificial
  Mutation in BnaC.FAD2.a introduced by TALE nuclease pair BnFAD2_T05
cctctcctccatcaccctctcccttacctcgcctggcccctctactgggcctgccaaggctgcgtcctaacgggcctctgggtcatcgcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaataagaagtcacacatcaagtggtacggcaagtacctcaaccaccctttgggccgccccgtgattttaccggttcagttccctctcggctggcctttgtacttag

SEQ ID NO: 48604 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 48605 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaacccttcgggacgcaccgtgatgttaacagttcagttcacgctcggctggcctttgtacttag

SEQ ID NO: 48606 - DNA, 360 bp, Artificial
  Mutation in BnaC.FAD2.a introduced by TALE nuclease pair BnFAD2_T05
cctctcctccctcaccctctctcatacttcgcctggcctctctactgggcctgccaagggcgcgtcctaaccggcgtctgggtcatagcccacgagcgctccaccacgccttcagcgactaccagtggcttgacgacaccgtcggtctcatcttccactccttcctcctcgtccctttcttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48607 - DNA, 439 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaagactgagcctttcgttttatttgatgcctggcacagcaccggcaacagccgctggaccgtctccagcgcctgcttgccaccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtgcctcaacaaccctttgggacgcaccgtgatgttaacggttcagttcgctctcggcgggcttaggtattag

SEQ ID NO: 48608 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 48609 - DNA, 394 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaaaagcattgctcatcaatttgttgcaacgaacaggtcactatccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48610 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48611 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtaaggcaagtacctcaacaaccctttgggacgcaccgtgatgttaacggttcagttcactctcggctggcctttgtacttag

SEQ ID NO: 48612 - DNA, 353 bp, Artificial
  Mutation in BnaC.FAD2.a introduced by TALE nuclease pair BnFAD2_T05
cctctcctccctcaccctctccattacctcgcctggcccctctactgggcctgccaaggctgcgtcctaacgggcctctgggtcatcgcccacgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48613 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48614 - DNA, 351 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48615 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 48616 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagctactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 48617 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggccgttgtacttag

SEQ ID NO: 48618 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtcgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48619 - DNA, 360 bp, Artificial
  Mutation in BnaC.FAD2.a introduced by TALE nuclease pair BnFAD2_T05
cctctcctccctcaccctctctcctacttcgcctggcccctctactgggcctgccaaggctgcgtcctaacgggcctctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48620 - DNA, 358 bp, Artificial
  Mutation in BnaC.FAD2.a introduced by TALE nuclease pair BnFAD2_T05
cctctcctccctcaccctttaccttacctcgcctggcctctctactgggcctgccaagggtgcgtcctaaccggcgtctgggtcatagcccacgagtgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 48621 - DNA, 358 bp, Artificial
  Mutation in BnaC.FAD2.a introduced by TALE nuclease pair BnFAD2_T05
cctctcctccctcaccctctcccttacctcgcctgacccctctactgggcctgccaaggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggccgttgtacttag

SEQ ID NO: 48622 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 48623 - DNA, 360 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48624 - DNA, 359 bp, Artificial
  Mutation in BnaC.FAD2.a introduced by TALE nuclease pair BnFAD2_T05
cctctcctccctcaccctttctcctacttcgcctggtctctctactgggcctgccaagggtgcgtcctaaccggcgtctgggtcatagcccacgagtgcgcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48625 - DNA, 352 bp, Artificial
  Mutation in BnaC.FAD2.a introduced by TALE nuclease pair BnFAD2_T05
cctctcctccctcaccctctctcctacttcgcctggcccctctactgggcctgccaagggcgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatcccttggggacgcaccgtgatggtaacggttcagttcacgctcggctggcttttgtacttag

SEQ ID NO: 48626 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 48627 - DNA, 358 bp, Artificial
  Mutation in BnaC.FAD2.a introduced by TALE nuclease pair BnFAD2_T05
cctctcctccctcaccctctctcctacttcgcctggcctctctactgcgcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48628 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcattttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48629 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgtgagagacgaagtgtttgtccccaagaagaagtcagacatcaagtggtacggcaagtacctcaacaaccctttgggacgcaccgtgatgttaacggttcagttcactctcggctggccgtggtacttag

SEQ ID NO: 48630 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgaccccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctggcctttgtacttag

SEQ ID NO: 48631 - DNA, 319 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 48632 - DNA, 401 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccatcgccagccacgatggcggcaaacagccgctggacacaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48633 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48634 - DNA, 340 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48635 - DNA, 360 bp, Artificial
  Mutation in BnaC.FAD2.a introduced by TALE nuclease pair BnFAD2_T05
cctctcctccctcaccctctctcctacttcgtctggcctctctactgggcctgccaagggcgcgccctcaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggcacggcaagtacccgaacaagcctgagggacgcaaggggatgctaacggttcagttcactctcggctggcctttgtacttag

SEQ ID NO: 48636 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48637 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 48638 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48639 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 48640 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 48641 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagatgtcagacatcaagtggtacggcaagtacctcaacaaccctttgggacgcaccgtgatgttaacggttcagttcactctcggctggcctttgtacttag

SEQ ID NO: 48642 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggcttgacgacaccgtcggtctcatcttccactccttcctcctcgtcccttacttctcctggaagcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48643 - DNA, 356 bp, Artificial
  Mutation in BnaC.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggccgttgtacttag

SEQ ID NO: 48644 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 48645 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48646 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctgtgggacgccccgtgatgttaaaggttcaattcactctcggctgccctttgtacttag

SEQ ID NO: 48647 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggctggacgacaccgtcggtctcatcttccactccttcctcctcgtgccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48648 - DNA, 360 bp, Artificial
  Mutation in BnaC.FAD2.a introduced by TALE nuclease pair BnFAD2_T05
cctctcctccctcaccctctctcctacttcgcctggccactctactgcgcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgaggctaaccgtccaggtcacgctcggctggcctttgtacttag

SEQ ID NO: 48649 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48650 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 48651 - DNA, 362 bp, Artificial
  Mutation in BnaC.FAD2.a introduced by TALE nuclease pair BnFAD2_T05
cctctcctccctcaccctctctcctacttcgtctgtcctctctactgtgtctgccaagtgtccgtcctaaccggcgtctcggtcatatcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtcctccgtcatctacctcaacgtcagatggggacgcgacacagtcttaccggccccaccctctctcggctggcctttgtacttag

SEQ ID NO: 48652 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacaaccctttgggacgcaccgtgatgttaacggttcagttcactctcggctggcctttgtacttag

SEQ ID NO: 48653 - DNA, 356 bp, Artificial
  Mutation in BnaC.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 48654 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacacgggctccctcgagagagacgaagtgtttgtccccaagaagaagtcagacatcaagtggtacggcaagtacctcaacaaccctgtgggacgcaccatgaggttaaaggttcagttcactctcggctgcccgttgtccgtaa

SEQ ID NO: 48655 - DNA, 349 bp, Artificial
  Mutation in BnaC.FAD2.a introduced by TALE nuclease pair BnFAD2_T05
cctctcctccctcaccctctctcttacttcgcctggcctctctactgggcctgccaagggtgcgtcctaaccggcgtctgggtcatagcccaccactccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48656 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagttgtacgacaagtacctcaacaaccctttgggacgcaccgtgatgttaacggttcagttcacgctcggctggcctttgtacttag

SEQ ID NO: 48657 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgatgatggaagtaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 48658 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggattgacgccaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48659 - DNA, 383 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcctccagcggctgttgccggtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48660 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48661 - DNA, 379 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgagcctttcgttttatttgatgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48662 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48663 - DNA, 362 bp, Artificial
  Mutation in BnaC.FAD2.a introduced by TALE nuclease pair BnFAD2_T05
cctctcctccctcaccctctctcctacttcgcctggcctctctactgggcctgcccagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 48664 - DNA, 435 bp, Artificial
  Mutation in BnaC.FAD2.a introduced by TALE nuclease pair BnFAD2_T05
cctcttctccctcaccctctctcctacttcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggcttgacgacaccgtcggtctcatcttccactccttcctcctcgtcccttacttctcctggaagtacagtcatcgacgccaccattccaacactcgctccctcgagagagacgaagtgtttgtccccaagaagaagtcagacatcaagtggtacggcaagtacctcaacaaccctttgggacgcaccgtgaggttaacggttcagttcacgctcggctggcctttgtgcttag

SEQ ID NO: 48665 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48666 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48667 - DNA, 356 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48668 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggcacggcaagtacctcaacaaccctttgggacgcaccgtgaggttaacggttcagttcactctcggctggcctttgtacttag

SEQ ID NO: 48669 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 48670 - DNA, 349 bp, Artificial
  Mutation in BnaC.FAD2.a introduced by TALE nuclease pair BnFAD2_T05
cctctcctccctcaccctctctcctacttctcctggcctctctactgggcttcccaagggcgcgccctaaccggcgtctgggtcatagcccacgagcgatgattgaagtaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaagccttagggacgcaccgtgctgttaacggttcagttccctctcggctggcctttgtacttag

SEQ ID NO: 48671 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccccaacaaccctttgggacgcaccagaacggtaacggttccgttcactctcggctggcctttgtacttag

SEQ ID NO: 48672 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48673 - DNA, 361 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggccttgtacttag

SEQ ID NO: 48674 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcatggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 48675 - DNA, 359 bp, Artificial
  Mutation in BnaC.FAD2.a introduced by TALE nuclease pair BnFAD2_T05
cctcttctccctcaccctctctcctacttcgcctgtcctctctactgggcctgcccagggtgcgtcctaaccggcgtctgggtcatagcccacgagtacccaccacgccttcagccactaccagtggcttgacgacaccgtcggtctcatcttccactccttcctcctcctcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 48676 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagctactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48677 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 48678 - DNA, 359 bp, Artificial
  Mutation in BnaC.FAD2.a introduced by TALE nuclease pair BnFAD2_T05
cctctcctccctcaccctctctcctacttcgcctggcctctctactaagcctgccaagggtgcgtcctaaacggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccaggtcacgctcggctggcctttgtacttag

SEQ ID NO: 48679 - DNA, 362 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcctctgggtcatcgcccacgagtgcggcccaccacgccttcagcgactaccagtggcttgacgacaccgtcgggctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcacggtgatgttaacggttcagttcactctcggctggcctttgtacttag

SEQ ID NO: 48680 - DNA, 467 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccatcgccagcaatattggtggcaagcaggcgctggagacggtccagcggctgttgccggtgctgtgccaggcccacggcttgaccccccagcaggtggtggccatccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48681 - DNA, 357 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48682 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48683 - DNA, 462 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgactccagcgcctgcttgccgccatcgtggctccgccaccctccgggccgttgcttcacaacgttccaatccgctcccggcggatttgtcctactcaggagagcgtcaccacgccttcagcgactaccagtggcttgacgacaccgtcggtctcatctaccactccttccgccgcgtcccttacttctcctggaagtacagtcagcgacgccaccattccaacacgggctacctcgagagagacgaagtgtttgtccccaagaagaagtcagacaacaagtggtacggcaagtacctcaacaaccctttgggacgcaccgtgatgttaacggttcagttcactctcggctggcctttgtacttag

SEQ ID NO: 48684 - DNA, 358 bp, Artificial
  Mutation in BnaC.FAD2.a introduced by TALE nuclease pair BnFAD2_T05
cctcttctccctcaccctctctactacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48685 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48686 - DNA, 354 bp, Artificial
  Mutation in BnaC.FAD2.a introduced by TALE nuclease pair BnFAD2_T05
cctctactccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48687 - DNA, 355 bp, Artificial
  Mutation in BnaC.FAD2.a introduced by TALE nuclease pair BnFAD2_T05
cctctcctccctcaccctctctcctacttcgcctggcctctccactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48688 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48689 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48690 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgactaccagtggcttgacgacaccgtcggtctcatcttccactccttcctcctcgtcccttacttctcctggaagtacagtcatcgaccccaccattccaacactggctccctcgagagagacgaagtgtttgtccccaagaagaagtcagccatcaagtggtacggcaagacccccaacacccctttgggacgcaccgggatgttaacggttcatttccctctcggtgggctttggtactag

SEQ ID NO: 48691 - DNA, 471 bp, Artificial
  Mutation in BnaC.FAD2.a introduced by TALE nuclease pair BnFAD2_T05
cctctcctccctcaccctctctactacttcgcctggcctctctactgggcctgccaagggtgcgtcctaaccggcgtctgggtcatagcccacgagtgcggctggaccgtctccagcgcctgcttgccaccatcgtggctggcgatggccaccacctgctccggggtcaagccgtgggcctggcacagcaccggcaacagccgctggagacgaaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttagtccccaagaagaaatccgacatcaagtggtacggaaagtacctcaacaacccgctaggacgcacggtgatgctaaccgtccagttcacgctcggctggcctttgtacttag

SEQ ID NO: 48692 - DNA, 359 bp, Artificial
  Mutation in BnaC.FAD2.a introduced by TALE nuclease pair BnFAD2_T05
cctctcctccctcaccctctctcctacttcgcctggcccctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48693 - DNA, 364 bp, Artificial
  Mutation in BnaC.FAD2.a introduced by TALE nuclease pair BnFAD2_T05
cctctcctccctcaccctccctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48694 - DNA, 419 bp, Artificial
  Mutation in BnaC.FAD2.a introduced by TALE nuclease pair BnFAD2_T05
cctctcctccctcaccctctctcctacttcgtctggcctctttactgggcctgccaagggtgcgtcctaaccggcgtctgggtcatagcccacgagttcgtgtatcttcgagccagccacgatcgacattgatctggcacagcaccggatggtttgacgacaccacgccttcagcgactaccagtggcttgacgacaccgtcggtctcatcttccactccttcctcctcgtcccttacttctcctggaagtacagtcatcgacgccaccattccaaccctggctccctcgagagagacgaagtgtttgtccccaagaagaagtcagacatcaagtggtccggcaagtcccccaccgcgccagttggacgtacggtgctgctaaccctccctctccctctcggctggcctttgtacttag

SEQ ID NO: 48695 - DNA, 355 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48696 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48697 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48698 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcatgtacctcaacaaccctttgggacgcaccgtgatgttaacggttcagttcactctcggctggcctttgtacttag

SEQ ID NO: 48699 - DNA, 349 bp, Artificial
  Mutation in BnaC.FAD2.a introduced by TALE nuclease pair BnFAD2_T05
cctctgctccctcaccctctctcctacttcgcctggcctctctactgggcctgcaaagggtgcgtcctaaccggcgtctgggtcatagcccaccacgctttcagcgactaccagtggcttgacgacaccgtcggactcatcttccactccttcctcctcgtcccttacttctcctggaagtacagtcatcgacgccaccattccaacactggctccctcgagagagacgaagtgtttgtccccaagaagaagtcagacatcaagtggtacggcaggtacctcaacaaccctttgggacgcaccgtgatgttaacggttcagttcactctcggctggcctttgtacttag

SEQ ID NO: 48700 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggtcgcaccgtgatgttaacggttcagttcactctcggctggcctgtgtacttag

SEQ ID NO: 48701 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaggaagtcagacatcaagtggtacggcaagtacctcaacaaccctttgggacgcaccgtgatgttaacggttcagttcactctcggctggcctttgtacttag

SEQ ID NO: 48702 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48703 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccatgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48704 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 48705 - DNA, 319 bp, Artificial
  Mutation in BnaC.FAD2.a introduced by TALE nuclease pair BnFAD2_T05
cctcttctccctcaccctgtctcctacttcgcctggcctctctactgcgcctgccaagggtgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgttgttaacggttcaggtcactcttggcgggcttttgtacttag

SEQ ID NO: 48706 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48707 - DNA, 392 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48708 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48709 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 48710 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtccgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacaacccgttgggacgcaccgtgatgttaacggttcagttcactctcggctggccttcgtacttag

SEQ ID NO: 48711 - DNA, 359 bp, Artificial
  Mutation in BnaC.FAD2.a introduced by TALE nuclease pair BnFAD2_T05
cctctcctccctcaccctctctcctacttcgcctggccactctactgggcctgccaagggtgcgtcctaaccggcgtctgggtcatagcccacgagtgcggaccacgccttcagcgactaccagtggcttgacgacaccgtcggtctcatcatccactccttcctcctcgtcccttacttctcctggaagtacagtcatcgacgcctccattccaacactggctccctcgagagagacgaagtgtttgtccccaagaagaagtcagacatcaagtggtacggcaagtacctcaacaaccctttggaacgccccgtgatgttaacggttcagttcactctcggctggcctttgtacttag

SEQ ID NO: 48712 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccgcgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48713 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaagtcagacatcaagtggtacggcaagtacctcaacaacccttggggacgcaccgtgatgttaacggttcagttcactctcggctggcctgtgtacttag

SEQ ID NO: 48714 - DNA, 344 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcgtttgtccactggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48715 - DNA, 360 bp, Artificial
  Mutation in BnaC.FAD2.a introduced by TALE nuclease pair BnFAD2_T05
cctctcctccctcaccctctctcctacttcgcctggcctctctaatgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggggatgctaaccttccagttcacgctcggctggcctgagtacttag

SEQ ID NO: 48716 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48717 - DNA, 350 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacctttcagttcactctcgggtggcctgtgtacttag

SEQ ID NO: 48718 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48719 - DNA, 358 bp, Artificial
  Mutation in BnaC.FAD2.a introduced by TALE nuclease pair BnFAD2_T05
cctcttctccctcaccctctctcctacttcgcctggcctctctactgggcctgccaagggcgcgtcataaccggcgtctgggtcatagcccacgagtgccaccacgccttcagcgactaccagtggcttgaccacaccgtccgtctcatcttcccctccttcctcctcgtcccttacttctcctggaagtacagtcatcgacgccaccattccaacactggctccctcgagagagacgaagtgtttgtccccaagaagaagtcacacatcaagtggtacggcaagtacctcaacatccctttgggacgcaccgtgaggtaaaccgttcagttcacgctcggctggcctttgtacttag

SEQ ID NO: 48720 - DNA, 419 bp, Artificial
  Mutation in BnaC.FAD2.a introduced by TALE nuclease pair BnFAD2_T05
cctctcctccctcaccctctctcctacttcgcctggcccctctactgggcctgccaagggtgcgtcctaaccggcgtctgggtcatagcccacgagtgcgggtatcttcgagccagccacgatcgacattgatctggcgcagcaccggctggtttgactcccccacgccttcagcgcctaccagtggcttgacgccaccgtcggtctcatcttcccctccttcctcctcgtcccttccttctcctggaagtacagtcatcgacgccaccagtccaaccctggctccctcgagagagacgaagtgtttgtccccaagaagaagtcagacatcaagtggtacggcaagtagctcaacaacccttcgagacgcaccgtgatgtaaacggttcagttcacgctcggctggcctcagtgcttag

SEQ ID NO: 48721 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48722 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagccatcgacgccaccattccaacaccgtatccctcgagagggatgaagtgttcgtccccaagaagaaatccgacatcaagtggtacggaaagtacctcaacaacccgctaggacgcacggtgatgctaaccgtccagttcccgctcggctggcctttgtacttag

SEQ ID NO: 48723 - DNA, 359 bp, Artificial
  Mutation in BnaC.FAD2.a introduced by TALE nuclease pair BnFAD2_T05
ctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48724 - DNA, 357 bp, Artificial
  Mutation in BnaC.FAD2.a introduced by TALE nuclease pair BnFAD2_T05
cctctcctccctcaccctctctcctactccttctggcctctttactgggcttcccaagggcgcgccctcaccggcgtctgggtcatcgcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtgatacggcaagtaccccaacaacccagaggggcgcaccgtaatgttacccgttcagttcactctcggctggcctttgtacttag

SEQ ID NO: 48725 - DNA, 356 bp, Artificial
  Mutation in BnaC.FAD2.a introduced by TALE nuclease pair BnFAD2_T05
cctctcctccctcaccctctcccctacttcgcctggactctctaatgggcctgacaagggtgcgtcctaaccggcgtatgggtcatagcccacgagtgaccacgccttcagcgactaccagtggcttgacgacaccgtcggtctcatcttccactccttcctcctcgtcccttacttctcctggaagtacagccatcgacgccaccattccaacaccagatccctcgagagggatgaagtgttcgtccccaagaagaagtcagacatcaagtggtgcggcaagtaccgcaacaacccattgggacgcaccgtgatgttaacggttcagttcactctcggctggcctttgtacttag

SEQ ID NO: 48726 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48727 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacggcaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacgtag

SEQ ID NO: 48728 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacaaccctctgggacgcaccgtgatgttaacggttcagttcactctcggctggcctttgtacttag

SEQ ID NO: 48729 - DNA, 355 bp, Artificial
  Mutation in BnaC.FAD2.a introduced by TALE nuclease pair BnFAD2_T05
cctctcctccctcaccatctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 48730 - DNA, 351 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48731 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 48732 - DNA, 467 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccatcgccagcaatattggtggcaagcaggcgctggagacggtccaggcgctgttgccggtgctgtgccaggcccacggcttgaccccccagcaggtggtggccatccaccacgccttcagcgactaccagtggcttgacgacaccgtcggtctcatcttccactcctccctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48733 - DNA, 346 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48734 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggccgtggtacttag

SEQ ID NO: 48735 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48736 - DNA, 355 bp, Artificial
  Mutation in BnaC.FAD2.a introduced by TALE nuclease pair BnFAD2_T05
cctctcctccctcaccctctcccttacctcgcctggcccctctattgggcctcccaagggcgcgtcccaaccggcgtctgggtcatagcccacgagcgtcacgccttcagcgactaccagtggcttgacgacaccgtcggtctcatcttccactccttcctcctcgtcccttacttctcctggaagtacagtcatcgacgccaccattccaacactcgctccctcgagagagacgaagtgtttgcccccaagaagaagtcagacatcaagtggtacggcaagtacctcaacaaccctttgggacgcaccgggatgttaacgtttcagttcacccgcggctggcctgagtacttag

SEQ ID NO: 48737 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctgtgtacttag

SEQ ID NO: 48738 - DNA, 356 bp, Artificial
  Mutation in BnaC.FAD2.a introduced by TALE nuclease pair BnFAD2_T05
cctctctccctcaccctctctcctacttcgcctggcctctctactgggcctgccaagggtgcgtcctaaccggcgtctgggtcatagcccacgagtgcggcacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48739 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48740 - DNA, 349 bp, Artificial
  Mutation in BnaC.FAD2.a introduced by TALE nuclease pair BnFAD2_T05
cctctcctccctcaccctctcccttacctcgtctggccaccctactgggctagccaagggcgcgccctaaccgccgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacgagccagtgggacgcaccgggatgtctaccgttcatttccctctcggctggcctttgtacttag

SEQ ID NO: 48741 - DNA, 354 bp, Artificial
  Mutation in BnaC.FAD2.a introduced by TALE nuclease pair BnFAD2_T05
cctctcctccctcaccctctctcctacttcgcctggcccctctactgggcctgccaagggcgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctgtgtacttag

SEQ ID NO: 48742 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgacgatggaagtaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctttgggacgcaccgtgatgttaacggttcatttctctctcggctggcctttgtacttag

SEQ ID NO: 48743 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48744 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagtgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48745 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagtgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48746 - DNA, 433 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcggcaaacaaaccaccgctgggagcggtggtttttttgtttgcaagcagcagattacgcgcagaaaaaaaggacaccacgccttcagcgactaccaggggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48747 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48748 - DNA, 401 bp, Artificial
  Mutation in BnaC.FAD2.a introduced by TALE nuclease pair BnFAD2_T05
cctctcctccctcaccctctctcctacttcgcctggcctctctactgggccttccaagggtgcgtcctaaccggcgtctgggtcatagcccacgagtgcggcccatcgccagccacgatggcggcaaacagccgctggacaccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48749 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48750 - DNA, 403 bp, Artificial
  Mutation in BnaC.FAD2.a introduced by TALE nuclease pair BnFAD2_T05
cctctcctccctcaccctctctcctacttcgcctggcctctctactgcgcctgccaagggtgcgtcctaaccggcgtctgggtcatagcccacgagtgtcgggtttcgccacctctggtggtggccatcgccagcaatggcggtgaccccgccttcagcgactcccagtggcttgacgacaccgtcggtctcatcttccactccttcctcctcgtcccttacttctcctggaagtacagtcatcgacgcccccattccaacactggctccctcgagagagacgaagtgtttgtccccaagaagaagtcagacatcaagtggtacggcaagtacctcaacaaccctttgggacgcaccgtgatgttaacgggtcaggtcactctcgtctggcctttgtacttag

SEQ ID NO: 48751 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 48752 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 48753 - DNA, 439 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcggccattgctggcgatggccaccacctgctccggggtcaagccgtgggcctggcacagcaccggcaagcaggcgctggagagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttttccccaagaagaagtcagacatcaagtggtacggcaagtacctcaacaaccgttggggacgcaccgtgaggttaacggttcagttcactctcggccggcctttgtgcttag

SEQ ID NO: 48754 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctttgtacttag

SEQ ID NO: 48755 - DNA, 331 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcagcgactaccagtggcttgacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 48756 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggtaagtacctcaacaaccctttgggacgcaccgtgatgttaacggttcagttcactctcggctggcctttgtacttag

SEQ ID NO: 48757 - DNA, 358 bp, Artificial
  Mutation in BnaC.FAD2.a introduced by TALE nuclease pair BnFAD2_T05
cctctcctccctcaccctctctcctacttcgcctggcatctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48758 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtccgacatcaagtggtacggaaagtacctcaacaacccgctaggacgcacggtgatgctaaccgtccagttcacgcgcggccggcctttgtacttag

SEQ ID NO: 48759 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcccgttgtacttag

SEQ ID NO: 48760 - DNA, 328 bp, Artificial
  Mutation in BnaC.FAD2.a introduced by TALE nuclease pair BnFAD2_T05
cctctcctccctcaccctctcacctacttcgcctggcatctctactgggcctgccaagggcgcgtcctaaccgccgactgggtcatagcccacgagtgcgacgacaccgtcggtctcatcttccactccttcctcctcgtcccttacttctcctggaagtacagtcatcgactccaccatgccaacactggctccctcgagagagacgaagtgtttgtccccaagaagaagtcagacatcaagtggtacggcaagtacctcaacaagcctttgggacgcaccgtgattttaacggctcagttcactctcgtctggcctttgtactgag

SEQ ID NO: 48761 - DNA, 358 bp, Artificial
  Mutation in BnaC.FAD2.a introduced by TALE nuclease pair BnFAD2_T05
cctctcctcactcaccctctctcctacttcgcctggcctctctactgggcctgccaagggtgcgtcctaaccggcgtctgtgtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48762 - DNA, 349 bp, Artificial
  Mutation in BnaC.FAD2.a introduced by TALE nuclease pair BnFAD2_T05
cctctcctccctcaccctctctcctacttcgcctggcctctctcctgagcctgcccagggtgcgtcctaacctgcgtctgggtcctcgcccacccctccttcagcgactaccagtggctttacgacaccgtcggtctcatcttccactccttcctcctcgtcccttccttctcctggaagtacagtcatcgacgccaccattccaacactggctccctcgagagagacgaagtgtttgtccccaagaagaagtcagacatcaagtggtacggcaaggacctcaacaaccctttgggatgcacagtgatgttaccgttacagttcactcttgcccggcatttgtacttag

SEQ ID NO: 48763 - DNA, 395 bp, Artificial
  Mutation in BnaC.FAD2.a introduced by TALE nuclease pair BnFAD2_T05
cctctcctccctcaccctctctcctacttcgcctggcctctctactgagcctgccaagggtgcgtcctaaccggcgtctgggtcatagcccacgagtggtggccatcgccagcaatggcggtggcaaccgccgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 48764 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcctctgggtcatcgcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48765 - DNA, 467 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccatcgccagcaatattggtggcaagcaggcgctggagacggtccaggcgctgttgccggtgctgtgccaggcccacggcttgaccccccagcaggtggtggccatccaccacgccttcagcgactaccagtggcttgacgacaccgtcggtctcatcttccactccttcctcctcgtcccttacttctcctggaagtacagtaatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48766 - DNA, 344 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48767 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtccggaaagtacctcaacaaccctttgggacgcaccgggatgttaacggttcagttcactctcggctggcctttgtacttag

SEQ ID NO: 48768 - DNA, 355 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48769 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaaggctgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48770 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttaacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48771 - DNA, 357 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48772 - DNA, 360 bp, Artificial
  Mutation in BnaC.FAD2.a introduced by TALE nuclease pair BnFAD2_T05
cctctcctccctcaccctctatcctacttcgcctggcctctctcctgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgggatgttaacggttcaggtcactctcggctggcctttgtacttag

SEQ ID NO: 48773 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcacacgagtgcggggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48774 - DNA, 348 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcctccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtagctcaacaaccctgtgggatgcaccgtgatgttaacgctcccgttcactctcggctggcctttgtacttag

SEQ ID NO: 48775 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccaatggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48776 - DNA, 331 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 48777 - DNA, 359 bp, Artificial
  Mutation in BnaC.FAD2.a introduced by TALE nuclease pair BnFAD2_T05
cctctcctccctcaccctctatcctacttcgcctggcctctctactgcgtctgccaagggcgcgtcctaaccggcgtctgggtcatagcccacgagtgcccaccatgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48778 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48779 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48780 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagccatcgacgccaccattccaacactcgctccctcgagagagacgaagtgtttgtccccaagaagaagttagacatcaagtggtacggcaagtacctcaacaaccctttgggacgcaccgtgatgttaacggttcagttcactctcggctggcctttgtacttag

SEQ ID NO: 48781 - DNA, 358 bp, Artificial
  Mutation in BnaC.FAD2.a introduced by TALE nuclease pair BnFAD2_T05
cctctcctccctcaccctctctcctacttcgcctggcctctctaatgggcctgccaagggtgcgtcctaaccggcgtctgggtcatagcccacgagtgcgccaccactccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggccttgtcttag

SEQ ID NO: 48782 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccttgtgggacgcaccgggatgttaacggttcagttcactctcggctggcctttgtacttag

SEQ ID NO: 48783 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 48784 - DNA, 359 bp, Artificial
  Mutation in BnaC.FAD2.a introduced by TALE nuclease pair BnFAD2_T05
cctctcctccctcaccctctctcctacttcgcctggtctctctactgggcctgacaagggtgcgtcctaaccggcgtctgggtcatagcccacgagtggccaccacgccttcagctactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48785 - DNA, 359 bp, Artificial
  Mutation in BnaC.FAD2.a introduced by TALE nuclease pair BnFAD2_T05
cctctcctccctcaccctctcccttacctcgcctggcccttctactgggcctgccaaggctgcgtcctaacgggcctctgggtcatcgcccacgaatgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48786 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagtcatcgacaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48787 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttcacctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 48788 - DNA, 357 bp, Artificial
  Mutation in BnaC.FAD2.a introduced by TALE nuclease pair BnFAD2_T05
cctctcctccctcaccctctctcctacttcgcctggcctctctactgagcctgccaagggtgcgtcctaacaggcgccttggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48789 - DNA, 395 bp, Artificial
  Mutation in BnaC.FAD2.a introduced by TALE nuclease pair BnFAD2_T05
cctctcctccctcaccctctctcctacttcgcctggcatctctactgggcctgccaagggtgcgtcctaaccggcgtctgggtcatagcccacgagtggtggccatcgccagcaatggcggtggcaacagccgctggaccacgccttcagcgactaccagtggcttgacgacaccgtcggtctcatcttccactccttcctcctcgtcccttacctctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48790 - DNA, 359 bp, Artificial
  Mutation in BnaC.FAD2.a introduced by TALE nuclease pair BnFAD2_T05
cctctcctccctcaccctctcacctacttcgcctggcatctctaatgggcctgccacgggtgcgtcctaaccgccgtctgggtcatagcccacgagtgcggaccacgccttcagcgactaccagtggcttgacgacaccgtcggtctaatcttccactccttcctcctcgtcccttacttctcctggaagtccagtcatcgacgccaccattccaacactggctccctcgagagagacgaggtgtttgtccccaggaagaatgcagacaacaagtggtacgacagaaaccacaacaacctgttgggacgccccgggatgttatcgttgcatgtcacgcgcggctggcctgaatacttag

SEQ ID NO: 48791 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48792 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48793 - DNA, 334 bp, Artificial
  Mutation in BnaC.FAD2.a introduced by TALE nuclease pair BnFAD2_T05
cctctcctccctcaccctctctcctacttcgcctggcctctctactgggccatcgccagccacgatggcggcaagaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48794 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggcgggcctttgtacttag

SEQ ID NO: 48795 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactatcagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48796 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctaggctggcctttgtactgag

SEQ ID NO: 48797 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccacggctgcgtcctaaccggcctctgggtcatcgcccacgagtgccacccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtccggaaagtacctcaacaaccctttgggacgcacggtgatgttaacggtccagttcactctcggctggcctttgtacttag

SEQ ID NO: 48798 - DNA, 354 bp, Artificial
  Mutation in BnaC.FAD2.a introduced by TALE nuclease pair BnFAD2_T05
cctctcctccctcaccctctctcctacttcgcctggcctctttactgtgcctgccaagggcgcgtcctcaccagcgtctgggtcatagcccacgacaccccgccttcagcgactaccagtggcttgacgacaccgtcggtctcatcttcccctccttcctcctcgtcccttacttctcctggaagtacagtcatcgacgccaccattccaacactggctccctcgagagagacgaagtgtttgtccccaagaagaagtcagacatcaagtggtacggcaagtaccccaccaaccctgtgggacgcaccgtgatgttaacgcttccgctccctctcggctggcctttgtacttag

SEQ ID NO: 48799 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcacggtgatgctaaccgtccagttcacgctcggctggcctttgtacttag

SEQ ID NO: 48800 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcgtctggcctttgtgcttag

SEQ ID NO: 48801 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 48802 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccgacgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggtgcagttcactctcggctggcctttgtacttag

SEQ ID NO: 48803 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcgcctggcctttgtacttag

SEQ ID NO: 48804 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 48805 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactcctacctcctcgtcccttacttctcctggaagtacagtcatcgacgccaccattccaacaccggatccctcgagagagatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48806 - DNA, 362 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48807 - DNA, 346 bp, Artificial
  Mutation in BnaC.FAD2.a introduced by TALE nuclease pair BnFAD2_T05
cctctcctccctcaccctctctcctacttcgcctggcctctctactgtgcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48808 - DNA, 354 bp, Artificial
  Mutation in BnaC.FAD2.a introduced by TALE nuclease pair BnFAD2_T05
cctctcctccctcaccctctctcctacttcgcctggcatctctaatgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcgagtggtacggcaagtacctcaacaaccctttgggacgcaccgtgatgttaacggttcaggtcactctcgtctggcctttgtacttag

SEQ ID NO: 48809 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgactacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48810 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtaatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48811 - DNA, 357 bp, Artificial
  Mutation in BnaC.FAD2.a introduced by TALE nuclease pair BnFAD2_T05
cctctcctccctctccctctctcctacttcgcctggcctctctactgggcctgccaagggtgcgtcctaaccggcgtctgggtcatagcccactagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48812 - DNA, 419 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggtatcttcgagccagccacgatcgacattgatctggcacagcaccggatggtttgactccaccacgccttcagcgactaccagtggcttgacgacaccgtcggtctcatcttccactccttccttctcgtcccttacttctcctggaagtccagtcatcgacgccaccattccaacactgtctccctcgagagagacgaagggtttgtccccaagaagaagtcagacatcaagtggtacggcaagtacctcaacaaccctttgggacgcaccgggatgttaacggttcagttcactcgcggctggcatttgtacgtag

SEQ ID NO: 48813 - DNA, 354 bp, Artificial
  Mutation in BnaC.FAD2.a introduced by TALE nuclease pair BnFAD2_T05
cctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48814 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactag

SEQ ID NO: 48815 - DNA, 419 bp, Artificial
  Mutation in BnaC.FAD2.a introduced by TALE nuclease pair BnFAD2_T05
cctctcctccctcaccctctctcctacttcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48816 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48817 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 48818 - DNA, 362 bp, Artificial
  Mutation in BnaC.FAD2.a introduced by TALE nuclease pair BnFAD2_T05
cctctcctccctcaccctctctcctacttcttctggcctctctactgggcctgccaagtgcgcgtcctaaccggcgtctgggtcatagcccacgagtgtggcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaccccactaggacgcacggtgatgctaaccctcccgttcccgctcggctggcctttgtacttag

SEQ ID NO: 48819 - DNA, 359 bp, Artificial
  Mutation in BnaC.FAD2.a introduced by TALE nuclease pair BnFAD2_T05
cctccctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48820 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48821 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcatcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48822 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagccactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacatccctgtgggacgcaccgtgatgttaacggttcagttcactctcggctggcctttgtacttag

SEQ ID NO: 48823 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcactctcggctggcctttgtacttag

SEQ ID NO: 48824 - DNA, 356 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48825 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 48826 - DNA, 394 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaaaagcattgctcatcaatttgttgcaacgaacaggtcactatccaccacgccttcagcgactacaagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48827 - DNA, 394 bp, Artificial
  Mutation in BnaC.FAD2.a introduced by TALE nuclease pair BnFAD2_T05
cctctcctccctcaccctctctcctacctcgtctgctttccctactggtcttgacatgggtgcgtccaaaccggcgtctgggacatagcacaaaagcattgctcatcaatttgttgcaacgaacaggtcactatccaccacgccttcagcgactacaagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacgtcaagtacctcaacaacccttttgggcgcacgataaagttaacgctcccgttcactctcggctggcctttgtacttag

SEQ ID NO: 48828 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48829 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgcgatgttaacggttcagttcactctcggctggcctttgtacttag

SEQ ID NO: 48830 - DNA, 360 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48831 - DNA, 354 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgacaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48832 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcttcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48833 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48834 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 48835 - DNA, 355 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctcaccggcgtctgggtcatagcccacgagtaccacgccttcagcgcctaccagtggcttgaccacaccgtcggtctcatcttccactccttcctcctcgtcccttacttctcctggaagtacagtcatcgacgccaccattccaacactggctcccgcgagagagacgaagtgtttgtccccaagaagaaatccgacatcaagtggtacggaaagtacctcaacaaccctgtgggacgcactgtgaggttaacggttcaattcactctcggctggcctttgtacctac

SEQ ID NO: 48836 - DNA, 401 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccttcagcgaccaccagtggcttgacgacaccgtcggtctcatcttccactccttcctcctcgtcccttacttctcctggaagtacagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48837 - DNA, 440 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaagactgagcctttcgttttatttgatgcctggcacagcaccggcaacagccgctggaccgtctccagcgcctgcttgcaaccgccaccacgccttcagcgactaccagtggcttgacgccaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctgtgggacgcaccgtgatgttaacggttcagttcactctcggctggcctttgtacttag

SEQ ID NO: 48838 - DNA, 418 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttaaaacgaaaggcccagtcttccgactgatcctttcgttttatttgatgcctggcagttcccgaccacgccttcagcgactaccagtggctttacgacaccgtcggtttcatcttccactccttcctcctcgtcccttacttctcctggaagtacagccatagacgccaccattccaacaccggatccctcgagagggatgaagtgttcgtccccaagaagaaatccgacatcaagtggtacggaaagtacctcaacaacacgctaggacgccgggtgatgcaaaccgtccagttcacgctcggctggcctttgtacttag

SEQ ID NO: 48839 - DNA, 418 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttaaaacgaaaggcccagtcttccgactgagcctttcgttttatttgatgcctggcagttcccgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 48840 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtacttag

SEQ ID NO: 48841 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgagtaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48842 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48843 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagccatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48844 - DNA, 346 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48845 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctgccctttgtacttag

SEQ ID NO: 48846 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48847 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48848 - DNA, 395 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaacagccgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctttgggacgcacagggatgttaacgttccagctcactctcggctggcctttgtacttag

SEQ ID NO: 48849 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactcattcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48850 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48851 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctactggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 48852 - DNA, 340 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48853 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 48854 - DNA, 379 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgagcctttcgttttatttgatgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48855 - DNA, 419 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggcatcttcgagccagccacgatcgacattgatctggcacagcaccggatggtttgactccaccacgccttcagcgactaccagtggcttgacgacaccgtcgggctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactcccgcctggcctttgtacttag

SEQ ID NO: 48856 - DNA, 407 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccattgctggcgatggccaccacctgctggggggtcaagccgtgggcctggcacacgccttcagcgactaccagtggcttgacgacaccgtcggtctcatcttccactccttcctcctcgtcccttacttctcctggaagtacagtcatcgacgccaccattccaacactggccccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48857 - DNA, 346 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtgcctcagcaagcctttgggacgcaccgggatgttaacggttcagttctctttcggctggcctttgtacttag

SEQ ID NO: 48858 - DNA, 356 bp, Artificial
  Mutation in BnaC.FAD2.a introduced by TALE nuclease pair BnFAD2_T05
cctctcctccctcaccctctctcctacttcgcctggcccctctactgggcctgccaaggctgcgtcctaacgggcctctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48859 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcctcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48860 - DNA, 359 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcccaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacaatggctccctcgagagagacgaagtgtttgtccccaagaagaaggcagacatcaagtggtacggcaagtgcctcaacaagcctcgggatcgcaccgtgatgtttacggttcaggtcactctcggatgccatgagcacttat

SEQ ID NO: 48861 - DNA, 358 bp, Artificial
  Mutation in BnaC.FAD2.a introduced by TALE nuclease pair BnFAD2_T05
cctctcctccctcaccctctctcctacttcgcctggcctctctactgagcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagtcatcgacgcctccattccaacactggctccctcgagagagacgaagtgtttgtccccaagaagaagtcagacatcaagtggtacggcaaggtcctcaacaaccctttgggacgcaccgtgatgttaacgggtcatgtcactctcgcctgccctttgtacttag

SEQ ID NO: 48862 - DNA, 440 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaagactgagcctttcgttttatttgatgcctggcacagcaccggcaacagccgctggaccgtctccagcgcctgcttgccaccgccaccacgccttcagcgactaccagtggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccgttggggacgcaccgggatgttaacggttcagttcactctcggctggcctttgtacttag

SEQ ID NO: 48863 - DNA, 440 bp, Artificial
  Mutation in BnaC.FAD2.a introduced by TALE nuclease pair BnFAD2_T05
cctctcctccctcaccctctctcctacttcgcctgaactctctactgggcctgccaagggtgcgtcctaaccggcgtctgggtcatagcccacgagaagactgagcctttcgttttatttgatgcctggcacagcaccggcaacagccgctggaccgtctccagcgcctgcttgccaccgccaccacgccttcagcgactaccagtggcttgacgacaccgtcggtctcatcttccactccttcctcctcgtcccttaattatcctggaagtacagccatcgacgccaccattccaacaccggatccctcgagagagacgaagtgttggtccccaagaagaagttagacatcaagtggtacggcaagtacctcaacaaccgtgtgggacgcatagggagcgtaacgggacaggtcactctcgggtggccttagtacatag

SEQ ID NO: 48864 - DNA, 357 bp, Artificial
  Mutation in BnaC.FAD2.a introduced by TALE nuclease pair BnFAD2_T05
cctctcctccctcaccctctctcctacttcgcctggcctctctactgcgcctgccaagggtgcgtcctaacaggcgcctgggtcatagctcacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaattcacacatcaagtggtacggcaagtgcctcaacaagccttttggacgcaccgtgattttaacggttcaattcactctcgtctgcccttagtgcttag

SEQ ID NO: 48865 - DNA, 462 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgactccagcgcctgcttgccgccatcgtggctccgccaccctccgggccgttgcttcacaacgttcaaatccgctcccggcggatttgtcctactcaggagagcgtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacctttatgttaacggttcagttcactctcggctggcctttgtacttag

SEQ ID NO: 48866 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 48867 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtactgaaagtacctcaacaacccgctaggacgcacggtgatgctaaccgtccagttcacgctcggctggccttgtacttag

SEQ ID NO: 48868 - DNA, 354 bp, Artificial
  Mutation in BnaC.FAD2.a introduced by TALE nuclease pair BnFAD2_T05
cctctcctccctcaccctctctcctacttcgcctggcatctctaatgggcctgccaagggtgcgtcctaaccggcgtctgggtcatagcccacgacaccaagccttcagcgactaccagaggcttgacgacaccgtcggtctcatcttccactccttcctcctcgtcccttacctctcctggaaggacagtcatcgatgccaccattccaacactggctccctcgagagagactacgtgtttgtccccaagaggaagtcagacatcaagtggtacggcgagtgcctcaagaaccttttgggtcgccccgtgatgttaacgtttcatgtcattcgcggctgccctgagtacttag

SEQ ID NO: 48869 - DNA, 471 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctggggggtcaagccgtgggcctggcacagcaccggcaacagcgcaatgacattcttgcaggtatggccaccacctggggggtcaagccgtgggcctggcacagcaccggcaacagccgctggaccgtctccagcgcctgcttgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctgtgtacttag

SEQ ID NO: 48870 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 48871 - DNA, 358 bp, Artificial
  Mutation in BnaC.FAD2.a introduced by TALE nuclease pair BnFAD2_T05
cctctctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48872 - DNA, 355 bp, Artificial
  Mutation in BnaC.FAD2.a introduced by TALE nuclease pair BnFAD2_T05
cctctcctccctcaccctctctcctacttcgtctggcctccctactggtattcccatgtccgcgcccaaaccgccgtctggatcatagcccacgagtgtcaccccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtccgtcaattcgcccaacgcccctgatggatgcaccgtgctgttaccggttcagttccctctcggctggcctttgtacttag

SEQ ID NO: 48873 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcacgccttcagcgactaccagtggcttgacgacaccatcggtctcatcctccactccttcctcctcgtcccttacttctcctggaagtacagtcatcgacgccaccattccaacactggctccctcgagagagacgaagtgtttgtccccaagaagaagtcagacatcaagtggtacgacaagtgcctcaacaaccctttgggacgccccgggatgttaacggttcagttcactctcggctggcctgtgtacttag

SEQ ID NO: 48874 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 48875 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgcgaggacgcacggtgatgctaaccgtccatttcacgctcggctggcctttgtacttag

SEQ ID NO: 48876 - DNA, 433 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcggcaaacaaaccaccgctggtagcggtggtttttttgtttgcaagcagcagattacgcgcagaaaaaaaggacaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48877 - DNA, 354 bp, Artificial
  Mutation in BnaC.FAD2.a introduced by TALE nuclease pair BnFAD2_T05
cctctcctccctcaccctctctcctacttcgcctggcccctctactgggcctgccaaggctgcgtcctaacgggcctctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctatgggacgcaccgagatgttaacgggtcagttcactcgcggctgccctgagtacttag

SEQ ID NO: 48878 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgatgatggaagtaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctgacctttgtacttag

SEQ ID NO: 48879 - DNA, 395 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaacagccgctggaccacgccttcagcgactaccagtggcttgacgacaccgtcggtctcatcttcccctccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 48880 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48881 - DNA, 407 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccattgctggcgatggccaccacctgctggggggtcaagccgtgggcctggcacacgccttcagcgactaccagtggcttgacgacaccgtcggtctcatcttccactccttcctcctcgtcccttacttctcctggaagttcagtcttcgacgccaccattccaacactggctccctcgagagagacgaagtgtttgtccccaagaagaagtcagacatcaagtggtacggcaagtccctcaacaaccctgtgggacgcaccgggatgttaacggttcatgtcactctcggctggcctttgtacttag

SEQ ID NO: 48882 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttg

SEQ ID NO: 48883 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48884 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgccctttgtacttag

SEQ ID NO: 48885 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggcttgacgacaccgtcggtctcttcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48886 - DNA, 355 bp, Artificial
  Mutation in BnaC.FAD2.a introduced by TALE nuclease pair BnFAD2_T05
cctctcctccctcaccatctctcctacttcgcctggactctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48887 - DNA, 360 bp, Artificial
  Mutation in BnaC.FAD2.a introduced by TALE nuclease pair BnFAD2_T05
cctctcctccctcaccctctctcctacttcgcctgtcctctctactgggcctgccaagggtgcgtcctcaccggcgtctgggtcatagcccacgagtgcgccaccacgccttcagcgactaccagtggcttgacgacaccgtcgatctcatcttccactccttcctcctcgtcccttacttctcctggaagtacagtcatcgacgccaccattccaacactggctccctcgcgagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 48888 - DNA, 360 bp, Artificial
  Mutation in BnaC.FAD2.a introduced by TALE nuclease pair BnFAD2_T05
cctctcctccctcaccctctctcctacttcgcctggcctctctcctgggcctgcccagagtgcgtcctcaccggcttctgggtcatagcccactagtgcgccaccacgccttcagcgactaccattggcttgacgacaacttcgatctcatcttccactccttcctccgcgtcccttacttctcctggaagtacagtcatcgacgccaccattccaacactggctccctcgagagagacgaagtgttggtccccaagaagaaggcagacatcaagtggtacgacaagtacctcaacagccctgtgggacgcaccgtgatgttaacggttcaggtcactctcggctggcctttgtacttag

SEQ ID NO: 48889 - DNA, 323 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48890 - DNA, 389 bp, Artificial
  Mutation in BnaC.FAD2.a introduced by TALE nuclease pair BnFAD2_T05
cctcctcaccctctctcctacttcgcctggcctctctactgggcctgccaagggtgcgtcctaaccggcgtctgggtcatagcccacgagtggtggccatcgccagcaatggcggtggcaacagccgccggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48891 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagctactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48892 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagccatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48893 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcctcttccactccttcctcctcgtcccttacttctcctggaagtacagtcatcgacgccaccattccaacactggctccctcgagagagacgaagtgtttgtccccaagaagaaatcagacatcaagtggtacggcaagtacctcaacagccctttgggacgcaccgtgatgttaacggttcagttcactcgcgcctgcccttagtacttag

SEQ ID NO: 48894 - DNA, 331 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48895 - DNA, 395 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcattgcccacgagtggtggccatcgccagcaatggcggtggcaacagccgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttatacttag

SEQ ID NO: 48896 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgggatgttaacggttcagttaactcgcggctggcctttgtacttag

SEQ ID NO: 48897 - DNA, 364 bp, Artificial
  Mutation in BnaC.FAD2.a introduced by TALE nuclease pair BnFAD2_T05
cctctcctccctcaccctctctcctacttcgcctggcctccctactgggcctgccaaggctgcgtcctaaccggcgtctgggtcatagcccacgagtgcggccgccaccacgcctgcagcgactaccagtggcttgacgacaccgtcggtctcatcttccactccttcctcctcgtcccttacttctcctggaagtacagtcatcgacgccaccattccaacactggctccctcgagagagacgaagtgtttgtccccgagaagaagtcagacatcaagtggtacggcaagtacctcaacaaccctttggaacgcaccggaatgttaacggttcagttcactcgcggctgccatgtgtacttag

SEQ ID NO: 48898 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaaggctgcgtcctaaccggcgtctgggtcatagcccacgagccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagttcctcaacaacccttttgaacgcaccgtgatgttaacggttcagttcactctcggctgcccttagtgcttag

SEQ ID NO: 48899 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgctaccacgccttcagcgactaccagtggcttgacgacaccgtcggtctcatcttccactccttcctcctcgtcccttacttctcctggaagtacagtcatcgacgccacaattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48900 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccacaagaagaaatccgacatcaagtggtacggaaagtacctcaacaacccgctaggacgcacggagatgctaacggttcagttcactctcggctggcctttgtacttag

SEQ ID NO: 48901 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctgtgggacgcaccgtgatgttaacggttcagttcactctcggctggcctttgtacttag

SEQ ID NO: 48902 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48903 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 48904 - DNA, 360 bp, Artificial
  Mutation in BnaC.FAD2.a introduced by TALE nuclease pair BnFAD2_T05
cctctcctccctcaccctctctcctacttcgcctggtctctctactgggcctgccaagggtgcgtcctaaccggcgtatgggtcatagcccacgagtgcgccaccacgccttcagcgactaccagtggcttgacgacaccgtcggtctcatcttccactccttcctcctcgtcccttacttctcctagaagtacagtcatcgacgccaccattccaacactggctccctcgagagagacgaagtgtttgtccccaagaagaagtcaaccgacaggtggtacggcaagttcctcaacaaccctttgggacgcgccgtaatgttaacggttcagttcgctctcggctggcctttgtacttag

SEQ ID NO: 48905 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 48906 - DNA, 331 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48907 - DNA, 358 bp, Artificial
  Mutation in BnaC.FAD2.a introduced by TALE nuclease pair BnFAD2_T05
cctctcctccctcaccctctcccttacctcgcctggcccctctactgggcttgccaaggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccccaacacccctgtgggacgcaccgggatgttaccggttcaggtctctctcggctggcctttgtacttag

SEQ ID NO: 48908 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcataaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagccagacatcaagtggtacggcaagtacctcaacatccctttgggacgcatcgtgattttaacggttcagttcactctcggctggcctttgtacttag

SEQ ID NO: 48909 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48910 - DNA, 343 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 48911 - DNA, 394 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaaaagcattgctcatcaatttgttgcaacgaacaggtcactatccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccgtttgggacgcaccgtgatgttaacggttcagttcactatcggctggcctttgtacttag

SEQ ID NO: 48912 - DNA, 354 bp, Artificial
  Mutation in BnaC.FAD2.a introduced by TALE nuclease pair BnFAD2_T05
cctctcctccctcaccctctctcctacttcgcctggcctctctactggacctaccaaggctgcgacctaaccggcatctgggtcatagcccacgacaccactccttaagcgactaccagtggcttgacgacaccgtcggtctcatcttccactccttcctcctcgtcccttacttctcctggaagtacagtcatcgacgccaccattccaacactcgctccctcgagagagacgaagtgtttgtccccaagaagaagtcagacatcaagtggtaaccccactactccaccaccccgtcaggagtgaatgtgaggctacctgtccagttcccccccggccggcctttgtacttag

SEQ ID NO: 48913 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactcgcggctggccttagtacttag

SEQ ID NO: 48914 - DNA, 349 bp, Artificial
  Mutation in BnaC.FAD2.a introduced by TALE nuclease pair BnFAD2_T05
cctctcctccctcaccctctctcctacttcgcctagcctctctactgggcctgcaaagggtgcgtcctaaccggcgtctgggtcatagcccaccacgctttcagcaactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48915 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcttctgggtcatagcccaccagtgcgtactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaatggttcagttcactctcggctggcctttgtacttag

SEQ ID NO: 48916 - DNA, 352 bp, Artificial
  Mutation in BnaC.FAD2.a introduced by TALE nuclease pair BnFAD2_T05
cctctcctccctcaccctctctactacttcgcctggcctctctactcggcctgccaagggcgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacatccgtttgggacgcagcgtggtttaaacggttcagttccggctaggctggccttagtaattag

SEQ ID NO: 48917 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48918 - DNA, 360 bp, Artificial
  Mutation in BnaC.FAD2.a introduced by TALE nuclease pair BnFAD2_T05
cctctcctccctcaccctctctcctacttcgcctggactctctactgggcctgccaagggtgcgtcctaaccggcgtctgggtcatagcccacgagtgcgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgattttaacggttcaggtcactcttggctggcctttgtacttag

SEQ ID NO: 48919 - DNA, 360 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccactagtggcttgacgacaccgtcggtctcatcttccactccttcctcctcgtcccttacttctcctggaagtacagtcatcgacgccaccattccaacactggctacctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48920 - DNA, 333 bp, Artificial
  Mutation in BnaC.FAD2.a introduced by TALE nuclease pair BnFAD2_T05
cctctcctccctcaccctctctcctacttcgcctggcctctctactaggcctgagcaggttattgctggggggtcaccacgccttcagcgactaccagtggcttgacgacaccgtcggtctcatcttccactccttcctcctcgtcccttacttctcctggaagtacagccatcgacgccaccattccaacaccgaatccctcgagagggatgaagtgttcgtccccaagaagaagtcagacatcaagtggtacggcaagtacctcaacaaccctttgggacgcaccgtggtgttaacggttcatttcactctcggctggcctttgtacttag

SEQ ID NO: 48921 - DNA, 360 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48922 - DNA, 394 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaaaagcattgctcatcaatttgttgcaacgaacaggtcactatccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 48923 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggccttagtacttag

SEQ ID NO: 48924 - DNA, 357 bp, Artificial
  Mutation in BnaC.FAD2.a introduced by TALE nuclease pair BnFAD2_T05
cctctcctccctcaccctctctcctacttcgcctggactctctactgggcctgccaagggtgcgtcctaaccggcgtctgggtcatagcccacgagtgcggcacgccttcagcgactaccagtggcttgacgacaccgtcggtctcatcttccactccttactcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 48925 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggccggcctttgtacttag

SEQ ID NO: 48926 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgttcactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48927 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 48928 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 48929 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggatgcaccgtgatgttaacggttcagttcactctcggctggcctttgtacttag

SEQ ID NO: 48930 - DNA, 353 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48931 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaggaaatccgacatcaagtggtacggaaagtacctcaacaacccgctaggacgcacggtgatgctaaccgtccagttcacgctcggctggcctttgtacttag

SEQ ID NO: 48932 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 48933 - DNA, 359 bp, Artificial
  Mutation in BnaC.FAD2.a introduced by TALE nuclease pair BnFAD2_T05
cctctcctccctcaccctctctcctacttcgcctggactctctactgggcctgccaagggtgcgtcctaaccggcgtctgggtcatagcccacgagcgccaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 48934 - DNA, 319 bp, Artificial
  Mutation in BnaC.FAD2.a introduced by TALE nuclease pair BnFAD2_T05
cctctcctccctcaccctctcggctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcatgtacctcaacaaccctttgggacgcaccgtgatgttaacggttcagttcactctcggctggcctttgtacttag

SEQ ID NO: 48935 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaatggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48936 - DNA, 359 bp, Artificial
  Mutation in BnaC.FAD2.a introduced by TALE nuclease pair BnFAD2_T05
cctctcctccctcaccctgtctcctacttcgtctggcctcactactgggcctgccaagggagcgtcctaaccggcgtctgggtcatagcccacgagtgcccaccacgccttcagcgactaccagtggcttgacgacaccgtcggtctcatctgccactccttcctcctcgtcccttacttctcctggaagtaaagtcatcgacgccaccattccaacactggctccctcgagagagacgaagtgtttgtccccaagaagaagtctgacatcaagtggtacggcaagtacctcaacaaccctttgggacgcgccgtcgtgttaacggtgcaggtcacactcggctggccgtggtactcag

SEQ ID NO: 48937 - DNA, 359 bp, Artificial
  Mutation in BnaC.FAD2.a introduced by TALE nuclease pair BnFAD2_T05
cctctcctccctcaccctctctgctacttcgcctgctctgtctactgggcctgccaagggtgcgtccacaccggcgtctgggtcatagcccacgagtgcggaccacgcattcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtccggcaagtacctcaacgaccctgtgggatgcaccggaatgttaacggttcatttccctctcggctggcctttgtacttag

SEQ ID NO: 48938 - DNA, 355 bp, Artificial
  Mutation in BnaC.FAD2.a introduced by TALE nuclease pair BnFAD2_T05
cctctcctccctcaccctctctactacttcgcctggcctctctactgagcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48939 - DNA, 362 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48940 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacaacccgttgggacgcaccgtgatgttaacggttcagttcactctcggctgccctttgtacttag

SEQ ID NO: 48941 - DNA, 395 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccacacagtgatattgatttgctggttacggtgaccaccacgccttcagcgactaccagtggcttgacgacaccgtcggtctcatcttccactcattcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48942 - DNA, 361 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttcactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48943 - DNA, 364 bp, Artificial
  Mutation in BnaC.FAD2.a introduced by TALE nuclease pair BnFAD2_T05
cctctcctccctcaccctctctcctacttcgcctggccactctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccttttgggacgcaccgtgatgttaacggtgcagttcactctcggctggcctttgtacttag

SEQ ID NO: 48944 - DNA, 355 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48945 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48946 - DNA, 349 bp, Artificial
  Mutation in BnaC.FAD2.a introduced by TALE nuclease pair BnFAD2_T05
cctctcctccctcaccctctctcctacttctcctgccctctctactgggcctgccaagtccgcgtcctcaccagcgtctgggtcatagcccaccaccctttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtcgcccaacaagcctttgggacgtacggggatgttaacccttccgttccctctcggctggcctttgtacttag

SEQ ID NO: 48947 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48948 - DNA, 345 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 48949 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 48950 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcacagtgatgttaacggttcagttcactctcggctggcctttgtacttag

SEQ ID NO: 48951 - DNA, 359 bp, Artificial
  Mutation in BnaC.FAD2.a introduced by TALE nuclease pair BnFAD2_T05
cctctcctccctcaccctctctcctacgtcgcctggcctctctactgcgcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacgggtcattgctctctcggctggccttagtacttag

SEQ ID NO: 48952 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 48953 - DNA, 419 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggtatcttcgagccagccacgatcgacattgatctggcacagcaccggatggtttgacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctaaacaaccctttgggacgcaccgtgatgttaacggttcagttcactctcggctggcctttgtacttag

SEQ ID NO: 48954 - DNA, 344 bp, Artificial
  Mutation in BnaC.FAD2.a introduced by TALE nuclease pair BnFAD2_T05
cctctcctccctcaccctctctcctacttcgcctggactctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48955 - DNA, 357 bp, Artificial
  Mutation in BnaC.FAD2.a introduced by TALE nuclease pair BnFAD2_T05
cctctcctccctcaccctctctcctacttcgcctggcctctctactgagcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 48956 - DNA, 348 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 48957 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 48958 - DNA, 435 bp, Artificial
  Mutation in BnaC.FAD2.a introduced by TALE nuclease pair BnFAD2_T05
cctctcctccctcaccctctcccttacctcgcctggcccctctactgagcctgccaaggctgcgtcctaacgggcctctgggtcattgcccacgaatgccaggcccacggcttgaccccggagcaggtgggggccatcgccagccacgatggcggcaagcaggcgctggagacggccaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccccttgggacgccccgtgatgttaacggttcagttctctctcggctggcctttgtacttag

SEQ ID NO: 48959 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccggtgggacgcaccgtgatgttaacggttcagttcactctcggctggcctttgtacttag

SEQ ID NO: 48960 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48961 - DNA, 467 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccatcgccagcaatattggtggcaagcaggcgctggagacggtccaggcgctgttgccggtgctgtgccaggcccacggcttgaccccccagcaggtggtggccatccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48962 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 48963 - DNA, 433 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcggcaaacaaaccaccgctggtagcggtggtttttttgtttgcaagcagcagattacgcgcagaaaaaaaggacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48964 - DNA, 362 bp, Artificial
  Mutation in BnaC.FAD2.a introduced by TALE nuclease pair BnFAD2_T05
cctctcctccctcaccctctctcctacttcgcctagcctctctactgcgcctgccaagggtgcgtcctaaccggcgtctgggtcctagcccacgagtgcgggccaccacgccttcagcgactaccagtgccttgacgacaccgtcggtctcatcttccactccttcctcctcgtcccttccttctcctggaagtacagtcatcgacgccaccattccaacactggctccctcgagagagacgaagtgtttgtccccaagaagaagtcacacatcaagtggtacggcaagtacctcaacaggccgttgggacgcaccgtcgtgttaacgtttcagtttactctgggcgggcgtgtgtacttag

SEQ ID NO: 48965 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccgagaagaagtcaaacatcaagtggtacggcaagtacctcaacaaccctttggaacgcaccgtgatgttaacggttcagttcactctcggctggcctttgtacttag

SEQ ID NO: 48966 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 48967 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctactggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48968 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccacttgcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctgtgtacttag

SEQ ID NO: 48969 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48970 - DNA, 357 bp, Artificial
  Mutation in BnaC.FAD2.a introduced by TALE nuclease pair BnFAD2_T05
ctctcctccctcaccctctcccttacctcgcctggcccctctactgggcctgccaagggtgcgtcctaaccggcgtctgggtcatagcccacgagtgcggccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48971 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48972 - DNA, 344 bp, Artificial
  Mutation in BnaC.FAD2.a introduced by TALE nuclease pair BnFAD2_T05
cctctcctccctcaccctctctcctacttcgcctcgcctctctactgagcctcccaagggtgcgccctaaccggcgtgtgggccatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctctgggacgcacaggggtcttacccgctccgttcactctcggctggcctttgtacttag

SEQ ID NO: 48973 - DNA, 363 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48974 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgccaccacgccttcagcgactaccagtggcttgacgacaccgccggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48975 - DNA, 356 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 48976 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctaggctggcctttgtacttag

SEQ ID NO: 48977 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccccgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48978 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48979 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 48980 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48981 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaaaaaccctttgggacgcaccgtgatgttaacggttcagttcactctcggctggcctttgtacttag

SEQ ID NO: 48982 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtaatgttaacggttcagttcactctcggctggcctttgtacttag

SEQ ID NO: 48983 - DNA, 353 bp, Artificial
  Mutation in BnaC.FAD2.a introduced by TALE nuclease pair BnFAD2_T05
cctctcctccctcaccctctctcctacttcgcctggcccctctactgggcctgccaaggctgcgtcctaacgggcctctgggtcatcgcccacgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48984 - DNA, 363 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48985 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48986 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtccggcaattacctcaacagccctgtgggacgcaccgtgaggttaaccgttcagtgcactctcggctggcctttgtacttag

SEQ ID NO: 48987 - DNA, 358 bp, Artificial
  Mutation in BnaC.FAD2.a introduced by TALE nuclease pair BnFAD2_T05
cctctcctccctcaccctctctcctacttcgcctggcctctctactgtgcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtcccccaacaaccctgtgggacgcaccgtgatgttaaccgttcagttcactctcggctggcctttgtacttag

SEQ ID NO: 48988 - DNA, 353 bp, Artificial
  Mutation in BnaC.FAD2.a introduced by TALE nuclease pair BnFAD2_T05
cctctcctccctcaccctctcccttacctcgcctggcccctctactgggcctgtcaaggctgcgtcctaacgggcctctgggtcatcgcccacgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtgatacgccaagtcccccaacacgcctgagggacgcaacgtgctgttaaccgttccgttccctctcggctggcctttgtacttag

SEQ ID NO: 48989 - DNA, 319 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 48990 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 48991 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 48992 - DNA, 344 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 48993 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactcccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcgagtggtacggaaagtacctcagcaacccgctaggacgcccggtggggctaagcgtccagttcacgctcggctggcctttgtacttag

SEQ ID NO: 48994 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 48995 - DNA, 358 bp, Artificial
  Mutation in BnaC.FAD2.a introduced by TALE nuclease pair BnFAD2_T05
cctctcctccatcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 48996 - DNA, 432 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcggcaaacaaaccaccgctggtagcggtggtttttttgtttgcaagcagcagattacgcgcagaaaaaaaggacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctagggcgcacggtgatgctaaccgtccagtgcacgctcggcgggcttttgacttag

SEQ ID NO: 48997 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcaactaccagtggcttgacgacaccgtcggcctcatcttccactccttcctcctcgtcccttacttctcctggaagtacagtcatcgacgccaccattctaacactggctccctcgagagagacgaagtgtttgtccccaagaagaagtcagacatcaagtggtacggcaagtacctcaacaaccctttgggacgcaccgtgatgttaacgtttcagttcacgctcggctggccgttgtacttag

SEQ ID NO: 48998 - DNA, 354 bp, Artificial
  Mutation in BnaC.FAD2.a introduced by TALE nuclease pair BnFAD2_T05
cctctcctccctcaccctctctcctacttcgcctggcctctccactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 48999 - DNA, 348 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgccaccacaccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49000 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 49001 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagactaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49002 - DNA, 353 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaaccacgccttcagcgactaccagtggcttgacgacaccgtcggtctcatcttccactccttcctcctcgtcccttacttctcctggaagtacagtcattgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttcgtacttag

SEQ ID NO: 49003 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 49004 - DNA, 359 bp, Artificial
  Mutation in BnaC.FAD2.a introduced by TALE nuclease pair BnFAD2_T05
cctctcctccctcaccctctctcctacttcgcctggccactctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaaccgttcagttcactctcggctggcctttgtacttag

SEQ ID NO: 49005 - DNA, 357 bp, Artificial
  Mutation in BnaC.FAD2.a introduced by TALE nuclease pair BnFAD2_T05
cctctcctccctcaccctctctcctacttcgcctggcctctctacttggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49006 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcactctcggctggcctttgtacttag

SEQ ID NO: 49007 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcctctgggtcatcgcccacgaatgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49008 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacggtcatcgacgccaccattccaacactggctccctcgagagagacgaagtgtttgtccccaagaagaagccagacatcaagtggtccggcaagtccctcaccaaccctttggtatgcaccgggctgctaccccttccgctccctctcggctggcctttgtacttag

SEQ ID NO: 49009 - DNA, 396 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcttctgggtcatagcccacgagtggtggccatcgccagcaatggcggtggcaagcaggcgctggaccacgccttcagcgactaccagtggcttgacgacaccgtccgtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtactgag

SEQ ID NO: 49010 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaggtcagacatcaagtggtacggcaagtacctcaacaaccctttgggacgcaccgtgatgttaacggttcagttcactctcggctggcctttgtacttag

SEQ ID NO: 49011 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 49012 - DNA, 359 bp, Artificial
  Mutation in BnaC.FAD2.a introduced by TALE nuclease pair BnFAD2_T05
cctctcctccctcaccctctctcctccttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtacccaagaagaagtcagacatcaagtggtacggcaagtacctcaacaaccctctgggacgcaccgtgatgttaacggttcagttcactctcggctggcctttgtacttag

SEQ ID NO: 49013 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagtccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgggtgagttcactctcggctgtcctttgtacttag

SEQ ID NO: 49014 - DNA, 440 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaagactgagcctttcgttttatttgatgcctggcacagcaccggcaacagccgctggaccgtctccagcgcctgcttgccaccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49015 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcatcgtgatgttaacggttgatttcactctcggctgtcctttgtacttag

SEQ ID NO: 49016 - DNA, 398 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcgggtttcggcaggtggtggccatcgccagcaatggcggtgaccacgccttccgcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49017 - DNA, 358 bp, Artificial
  Mutation in BnaC.FAD2.a introduced by TALE nuclease pair BnFAD2_T05
cctctcctccctcaccctctctactacttcgcctggcatctctactgggcctgccaagggtgcgtcctaaccggcgtctgggtcatagcccacgagtgccaccacgccttcagcgactaccagtggcttgacgacaccgtcgggctcatcttcccctccttcctcctcgtcccttacttctcctggaagtacagtcatcgacgccaccattccaacactggctccctcgagagagacgaagtgtttgtccccaagaagaagtcagacatcaagtggtacggcaaggacctcaacaaccctttgggacgcaccgtgatgttaacggttcatttcactctcggctggccttagtacttag

SEQ ID NO: 49018 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtccctttcttctcctggaagtacagtcatcgacgccaccattccaacactggctccctcgagagagacgaagtggttgtccccaagaagaagtcagacatcaagtggtacggcaagtacctcaacaaccctttggaacgcaccgtgatgttaacggtgcagttcactctcggctggcctttgtacttag

SEQ ID NO: 49019 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49020 - DNA, 392 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49021 - DNA, 354 bp, Artificial
  Mutation in BnaC.FAD2.a introduced by TALE nuclease pair BnFAD2_T05
cctctcctccctcaccctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49022 - DNA, 392 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49023 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49024 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 49025 - DNA, 357 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49026 - DNA, 328 bp, Artificial
  Mutation in BnaC.FAD2.a introduced by TALE nuclease pair BnFAD2_T05
cctctcctccctcaccctctctcctacttcgtctggcctctctactgggcctgccaagggcgcgccctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttagggacgcaccgtgatgttaaccgttcagttcactctcggctggcctttgtacttag

SEQ ID NO: 49027 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49028 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49029 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggtcgcaccgtgatgttaacggttcagttcactctcggctggcctttgtacttag

SEQ ID NO: 49030 - DNA, 395 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaacagccgctggaccacgccttcagcgactaccagtggcttgactacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49031 - DNA, 357 bp, Artificial
  Mutation in BnaC.FAD2.a introduced by TALE nuclease pair BnFAD2_T05
cctctcctccctcaccctctctcctacttcgcctggctactctactggtcctgccaagggcgcgccctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacgtcaattaccccaacaccccagtgggacgcaccggaatgttaacggtccagttccctctcggctggcctttgtacttag

SEQ ID NO: 49032 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccccgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttccgttcactctcggctggcctttgtacttag

SEQ ID NO: 49033 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49034 - DNA, 279 bp, Artificial
  Mutation in BnaC.FAD2.a introduced by TALE nuclease pair BnFAD2_T05
cctctcctccctaccctctctcctacttcgcctggcctctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49035 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49036 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49037 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtactag

SEQ ID NO: 49038 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgagtacttag

SEQ ID NO: 49039 - DNA, 403 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcgggtttcgccacctctggtggtggccatcgccagcaatggcggtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49040 - DNA, 409 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggtggcaagcaggcgctggagacggtccagcgcctgcttgccgccatcgcctaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49041 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49042 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgaccccaagaagaaatccgacatcaagtggtacggaaagtacctcaacaacccgctagaacgcacggtgatgctaaccgtccagttcacgctcggctggcctttgtacttag

SEQ ID NO: 49043 - DNA, 355 bp, Artificial
  Mutation in BnaC.FAD2.a introduced by TALE nuclease pair BnFAD2_T05
cctctcctcactcaccctctcccctacttcgcctggcctctacaatgggcctgccaagggtgcgtcctaatcagcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacagcaagtggtacggaaagtacctcaacaagcctggggtacgtactgtggtgtgaacgggtaagttcacgctcagcggcgctttgttcttaa

SEQ ID NO: 49044 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaacctgcgtctgggtcatcgcccacgagtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacgtag

SEQ ID NO: 49045 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 49046 - DNA, 280 bp, Artificial
  Mutation in BnaC.FAD2.a introduced by TALE nuclease pair BnFAD2_T05
cctctcttccctcaccctctctcctacttcgcctggcctctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49047 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactcattcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacgggtcagttcactctcggctggccttagtacgtag

SEQ ID NO: 49048 - DNA, 450 bp, Artificial
  Mutation in BnaC.FAD2.a introduced by TALE nuclease pair BnFAD2_T05
cctctcctccctcaccctctctcctacttcgcctggcctctcaactgggcctgccaagggtgcgtcctaaccggcgtctgggtcatagcccacgagcggctgttgccggtgctgtgccaggcccacggcttgaccccccgctccggggtctggccatcgccagccacgatggcggcaacagccgctggacccaccacgccttcagcgactaccagtggctggacgacaccgtcggtctcatcttccactccttcctcctcgtcccttacttctcctgtaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggcgttccgttgtacgtag

SEQ ID NO: 49049 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttgacggttcagttcactctcggctggcctttgtacttag

SEQ ID NO: 49050 - DNA, 331 bp, Artificial
  Mutation in BnaC.FAD2.a introduced by TALE nuclease pair BnFAD2_T05
cctctcctccctcaccctctctcctacttcgcctggactctctactgggcctgccaagggtgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgaggttaacggttcagttcactcgcggctggcctttgtacttag

SEQ ID NO: 49051 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccaggggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49052 - DNA, 352 bp, Artificial
  Mutation in BnaC.FAD2.a introduced by TALE nuclease pair BnFAD2_T05
cctctcctccctcaccctctctcctacttcgcctggtctctctactgggcctaccaagcgtgcgtcctaaccggcgtctgggtcatagcccacgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccccagaggacgatccgtgatggtaacggctccgtccactctcggctggcctttgtactaag

SEQ ID NO: 49053 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49054 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtaaggcaagtacctcaacaaccctttgggacgcacggtgatgctaaccgtccagttcacgctcggctggcctttgtacttag

SEQ ID NO: 49055 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacaccccgccttcagcgactaccagtggcttgccgacaccgtcggtctcatcttccactccttcctcctcgtcccttacttctcctggaagtacagtcatcgacgcccccattccaacactggctccctcgagagagacgaagtgtttgtccccaagaagaagtcagacatcaagtggtacggcaagtacctcaacaaccctttgggacgcaccgtgaggttaacggttcagttgactctcggctggcctttgtacttag

SEQ ID NO: 49056 - DNA, 356 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49057 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgcaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgggtacttag

SEQ ID NO: 49058 - DNA, 391 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggctttgtacttag

SEQ ID NO: 49059 - DNA, 355 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 49060 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaaggctgcgtcctaaccggcgtctgggtcttagcccacgagtgcacccacccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49061 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49062 - DNA, 358 bp, Artificial
  Mutation in BnaC.FAD2.a introduced by TALE nuclease pair BnFAD2_T05
cctctcctccctcaccctctctcctacttcgcctggcccctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49063 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacaatcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49064 - DNA, 328 bp, Artificial
  Mutation in BnaC.FAD2.a introduced by TALE nuclease pair BnFAD2_T05
cctctcctccctcaccctctctcctacttcgcctggcctctctactgcgcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 49065 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 49066 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtccagttcactctcggctggcctttgtacttag

SEQ ID NO: 49067 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagccaccacgccttcagcgactaccagtggcttgacgacaccgtcggtctcatcttccactccttcctcctcgtcccttacttctcctggaagtacagtcatcgacgccaccattccaacactggctccctcgagatagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49068 - DNA, 344 bp, Artificial
  Mutation in BnaC.FAD2.a introduced by TALE nuclease pair BnFAD2_T05
cctctcctccctcaccctctcacctacttcgcctggcaaatctaatgggcctgccaagggtgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggggatgctaaccttcgagttcacgctcggctggcctgtgtacttag

SEQ ID NO: 49069 - DNA, 419 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggtatcttcgagccagccacgatcgacattgatctggcacagcaccggatggtttgacgacaccacgccttcagcgactaccagtggcttgacgacaccgtcggtctcatcttccactccttcctcctcgtcccttacttctcctggaagtacagtcatcgacgccaccagtccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49070 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactacttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49071 - DNA, 354 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctggatcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtaatgttaacggttcagttcactctcggctggcctttgtacttag

SEQ ID NO: 49072 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcgccgtgaggttaacggttcagttcactctcggctggcctttgtacttag

SEQ ID NO: 49073 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacgtcaagtggtacggcaagtacccaacaaccctttgggacgcaccgtgatgttaacggttcagttcactctcggctggcctttgtacttag

SEQ ID NO: 49074 - DNA, 396 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaagcaagcgctggaccacgccttcagcgactaccagtggcttgacgacaccgtcggtctcatcttacactccttcctcctcgtcccttccttctcctggaagtacagacatcgacgccaccattccaacaccggatccctcgtgagggatgaagtgttcgtccccaagaagaaatccgacatcaagtggtacggaaagtacctcaacaacccgctaggacgcacggtgattctagccgtccagttcacgctcggctggcctttgtacttag

SEQ ID NO: 49075 - DNA, 466 bp, Artificial
  Mutation in BnaC.FAD2.a introduced by TALE nuclease pair BnFAD2_T05
cctctcctccctcaccctctctcctacttcgcctggcctctctcctgagcctgccaagggtgcgtcctaaccggcgtctgggtcatagcccacgagtgcggccatcgccagcaatattggtggcaagcaggcgctggagacggtccagcggctgttgccggtgctgtgccaggcccacggctttccccccccgcaggtggtggccctccaccacgccttccgcgactaccagtggcttgacgacaccgtcagtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtgcctcaacaacccgctaggacgcacggggatgctaaccgtccagttcgcgctcggctggcctagcgcttag

SEQ ID NO: 49076 - DNA, 281 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccctttgtacttag

SEQ ID NO: 49077 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtcgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcgccgtgatgttaacggttcagttcactctcggctggcctttgtacttag

SEQ ID NO: 49078 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49079 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccccgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgccatcaagtggtacggaaagtacctcaacaacccgctaggacgcacggtgatgctaaccgtccagttcacgctcggctggcctttgtacttag

SEQ ID NO: 49080 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgatgatggaagtaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49081 - DNA, 354 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttctctctcggcgggcctttgtacttag

SEQ ID NO: 49082 - DNA, 358 bp, Artificial
  Mutation in BnaC.FAD2.a introduced by TALE nuclease pair BnFAD2_T05
cctctcctccctcaccctctctcctacttcgcctggcatctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 49083 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcttggctggcctttgtccttag

SEQ ID NO: 49084 - DNA, 357 bp, Artificial
  Mutation in BnaC.FAD2.a introduced by TALE nuclease pair BnFAD2_T05
cctctcctccctcaccctctctcctacctcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49085 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgccaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49086 - DNA, 396 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaagcaggcgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49087 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggctagttcctcaacaaccctttgggacgcaccgtgatgttaccggttcagttcactctcggctggcctttgtacttag

SEQ ID NO: 49088 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcatttgtacttag

SEQ ID NO: 49089 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacagcccgctaggacgcacggtgatgctaaccgtccagttcacgctcggctggcctttgtacttag

SEQ ID NO: 49090 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49091 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacgtttcagttcactctcggctggcctttgtacttag

SEQ ID NO: 49092 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49093 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49094 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtacttag

SEQ ID NO: 49095 - DNA, 353 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgcaccacgccttcagcgactaccagtggctggacgacaccgtcggtctcatcttccactccatcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49096 - DNA, 346 bp, Artificial
  Mutation in BnaC.FAD2.a introduced by TALE nuclease pair BnFAD2_T05
cctctcctccctcaccctctctcctacttcgcctggcctctttactgcgcctgccaagggtgcgtcctaaccggcgtctgggtcatagcccacgccttcagcgactaccagtggcttgacgacaccgtcggtctcatcttccactccttcctcctcggcccttacttctcctggaagtacagtcatcgacgccaccattccaacactggctccctcgagagagacgaagtgtttgtccccaagaagaagtcagacatcaagtggtacggcaagtacctcaacaaccctttgggacgctccgtgatgttaacggttcagttcactctcggctggcctttgtacttag

SEQ ID NO: 49097 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49098 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49099 - DNA, 323 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcggccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 49100 - DNA, 359 bp, Artificial
  Mutation in BnaC.FAD2.a introduced by TALE nuclease pair BnFAD2_T05
cctctcctccctcaccctctctcctacttcgcctggcccctctactgggcctcccaagggtgcgccctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcagccagcctttgggacgcaccatagtgttacccttcccgttcactctcggctggcctttgtacttag

SEQ ID NO: 49101 - DNA, 353 bp, Artificial
  Mutation in BnaC.FAD2.a introduced by TALE nuclease pair BnFAD2_T05
cctctcctcctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtccattacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49102 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49103 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgatgatggaagtaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49104 - DNA, 345 bp, Artificial
  Mutation in BnaC.FAD2.a introduced by TALE nuclease pair BnFAD2_T05
cctctcctccctcccctctctcctacttcgcctggcctctctactgggcctgccaagggtgcgtcctaaccggcgtctgggtcatagcccacgccttcagcgactaccagtggcttgacgacaccgtcggtctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggcttgcctttgtacttag

SEQ ID NO: 49105 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49106 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgaccacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49107 - DNA, 379 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatcgcccacgaatgagcctttcgtgttatttgatgccaccaggccttcagcgactaccagtggcttgacgacgccgtcggtctcatcttccactccttcctcctcgtcccttacttctcctggaagtacagtcatcgacgccaccattccaacactggctccctcgagagagacgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49108 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49109 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttggcgacaccgtcggtctcatcttccactccttcctcctcgtcccttacttctcctggaagtacagtcatcgacgccaccattccaacactggctccctcgggagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49110 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacataaagtggtacggcaagtacctcaacaaccctttgggacgcaccgtgatgttaacggttcagttcactctcggctggcctttgtacttag

SEQ ID NO: 49111 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggcttgacgacaccgtccgtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49112 - DNA, 401 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccatcgccagccacgatggcggcaaacagccgctggacaccaccacgccttcagcgactaccagtggcttgacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49113 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 49114 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaacctgcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49115 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaaggctgcgtcctaacgggcctctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49116 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaacaggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49117 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcaccgtgatgttaacggttcagttcactctcggctggcctttgtacttag

SEQ ID NO: 49118 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccccgccttcagcgactaccactggctcgacgacaccctcggtctcatctttcactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctgtgggacgcaccgtgatgttaacggttcagttcactctcggctggcctttgtacgtag

SEQ ID NO: 49119 - DNA, 346 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49120 - DNA, 391 bp, Artificial
  Mutation in BnaC.FAD2.a introduced by TALE nuclease pair BnFAD2_T05
cctctcctcctcaccctctctcctacttcgcctggcctctctactgggcctgccaagggtgcgtcctaaccggcgtctgggtcatagcccacgagtgcttctagctgataaattcatgccggagagggtggccaccacgccttcagcgactaccagtggcttgacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49121 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtagccagacgaccatgtgggacggaccctgctgttaccccttcaccccaccctcggctggcctttgtacttag

SEQ ID NO: 49122 - DNA, 358 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacagcaagtggtacggcaagtacctcaacaaccctttgggacgcaccgggatgttaacggttcagttcactctcggctggcctttgtacttag

SEQ ID NO: 49123 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggacatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtaccgcaagtccctcaaaacgccttaggtacataacaggatgttaaccgttcagttccctctcggctggcctttgtacttag

SEQ ID NO: 49124 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 49125 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgccaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49126 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49127 - DNA, 379 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgagcctttcgttttatttgatgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggatcagttcactctcggctggccttggtacttag

SEQ ID NO: 49128 - DNA, 462 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgactccagcgcctgctttccgccatcgtggctccgccaccctccgggccgttgcttcacaacgttcaaatccgctcccggcggatttgtcctactcaggagagcgtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtatggcaagtacctcaacaaccatttgggacgcaccgtgatgttaacggttcagttcactctcggctggcctttgtacttag

SEQ ID NO: 49129 - DNA, 392 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 49130 - DNA, 359 bp, Artificial
  Mutation in BnaC.FAD2.a introduced by TALE nuclease pair BnFAD2_T05
cctctcctccctcaccctctctcctacttcttctcgcttctctactctgcttgccaagggcgcgccctcaccggcgtctgggccatagcccaccagtgtccaccaccccttcagcgactaccagtgtcttgacgacaccgtcggtctcatcttccactccttccttctcgtcccttacttctcctggaagtacagtcatcgacgccaccattccagcactggctccctcgagagagacgaattgtttgtccccaagaagaaatcagacatcaagtggtacggaaggtacctcaacaagccgcatggacgcacggtgaggctaagcgtccaggtcacgctcggctggcctttgtacttag

SEQ ID NO: 49131 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49132 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctactcgtccagttcacgctcggctggcctttgtacttag

SEQ ID NO: 49133 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcaactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49134 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49135 - DNA, 340 bp, Artificial
  Mutation in BnaC.FAD2.a introduced by TALE nuclease pair BnFAD2_T05
cctctcctccctcaccctgtctcctacttcgcctggcctctctcctcagcctgccaagggtgcgtcctaaccggcgtctgggtcatagcccacgagtgctaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccgtgtgggacgcaccgtgatgttaacggtgcaggtcacgctcggcgggcctttgtacgtag

SEQ ID NO: 49136 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcaccgtgatgttaacggtgcagttcactctcggctggcctttgtacttag

SEQ ID NO: 49137 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49138 - DNA, 358 bp, Artificial
  Mutation in BnaC.FAD2.a introduced by TALE nuclease pair BnFAD2_T05
cctctcctccctcaccctatctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49139 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 49140 - DNA, 357 bp, Artificial
  Mutation in BnaC.FAD2.a introduced by TALE nuclease pair BnFAD2_T05
cctctcctccctcaccctctctcctacttcgcctggcctctctactgggcctgcccagggtgcgccctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctgtgggacgcgccgtgaggttaacggttcagttcactctcggctggcctttgtacgtaa

SEQ ID NO: 49141 - DNA, 362 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49142 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacagccctttgggactcaccgtgatgttaacggttcagttcactctcggctggcctttgtacttag

SEQ ID NO: 49143 - DNA, 395 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaacagccgctggaccacgccttcagcgactaccagtggcttgacgacaccgtcggtctcatcttccactccttcctcctcgtcccttacttctactggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49144 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49145 - DNA, 353 bp, Artificial
  Mutation in BnaC.FAD2.a introduced by TALE nuclease pair BnFAD2_T05
ccttcctccctcaccctctctcctacttcgcctggcctctctactgggcctgccaagggtgcgtcctaaccggcgtctggatcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49146 - DNA, 407 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccattgctggcgatggccaccacctgctggggggtcaagccgtgggcctggcacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49147 - DNA, 349 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatcgcccacgagtgatgatggaagtaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49148 - DNA, 344 bp, Artificial
  Mutation in BnaC.FAD2.a introduced by TALE nuclease pair BnFAD2_T05
cctctcctccctcaccctctctcctacttcgcctggcctctctcctcggcctgccaagggtgcgtcctaaccggcgtctgggtcatagcccacgagtgcgtactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 49149 - DNA, 360 bp, Artificial
  Mutation in BnaC.FAD2.a introduced by TALE nuclease pair BnFAD2_T05
cctctcctccctcaccctatcccttacctcgcctggcccctctactgggcctgccaaggctgcgtcctaacgggcctctgggtcatcgcccacgagtgcggcaccaagccttcagcgactaccagtggcttgacgacaccgtcggtctcctcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcacggtgatgctaacggtgcagttcactctcggctggcctttgtacttag

SEQ ID NO: 49150 - DNA, 363 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49151 - DNA, 349 bp, Artificial
  Mutation in BnaC.FAD2.a introduced by TALE nuclease pair BnFAD2_T05
cctctcctccctcaccctctctcctacttcgcctcgcctctctactgggcctgcaaagggtgcgtcctaaccggcgtctgggtcatagcccaccacgctttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49152 - DNA, 356 bp, Artificial
  Mutation in BnaC.FAD2.a introduced by TALE nuclease pair BnFAD2_T05
cctctcctccccaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccatgatgttaacggttcagttcactctcggctggcctttgtacttag

SEQ ID NO: 49153 - DNA, 348 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49154 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49155 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacacgggctccctcgagagagacgaagtgtttgtccccaagaagaagtcagacatcaagtggtacggcaagtacctcaacacccctttgggacgcaccgtgaggttaacggttcagttcactctcggctggcctttgtacttag

SEQ ID NO: 49156 - DNA, 418 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttaaaacgaaaggcccagtcttccgactgagcctttcgttttatttgatgcctggcagttcccgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49157 - DNA, 357 bp, Artificial
  Mutation in BnaC.FAD2.a introduced by TALE nuclease pair BnFAD2_T05
ccttcctccctcaccctctctcctacttcgcctggcctctctaatgggcctgccaagggcgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacgacccgctaggacgcacggtgatgctaaccgtccagttcacgctcggctggcctttgtacttag

SEQ ID NO: 49158 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttaagttcactctcggctggcctttgtacttag

SEQ ID NO: 49159 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 49160 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccttccagttcacgctcggctggcctttgtacttag

SEQ ID NO: 49161 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49162 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49163 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49164 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49165 - DNA, 346 bp, Artificial
  Mutation in BnaC.FAD2.a introduced by TALE nuclease pair BnFAD2_T05
cctctcctccatcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49166 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaacgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49167 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactacttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 49168 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgctttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49169 - DNA, 359 bp, Artificial
  Mutation in BnaC.FAD2.a introduced by TALE nuclease pair BnFAD2_T05
cctctcctccctcaccctatctcctacttcgcctggcctctctactgggcctgccaagggtgcgtcctaaccggcgtctgggccatagcccacgagtgcggaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49170 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaaccacgccttcagcgactaccagtggcttgacgaaaccgtaggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49171 - DNA, 400 bp, Artificial
  Mutation in BnaC.FAD2.a introduced by TALE nuclease pair BnFAD2_T05
cctctccctcaccctctctcctacttcgcctggcctctctactgggcctgccaagggtgcgtcctaaccggcgtctgggtcatagcccacgagtgtcgggtttcgccacctctggtggtggccatcgccagcaatggcggtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49172 - DNA, 361 bp, Artificial
  Mutation in BnaC.FAD2.a introduced by TALE nuclease pair BnFAD2_T05
cctctcctccctcaccctctctcctacttcgcctggcctctctactgggcctccaaagggggcgcccaacccgcctcttggtcattggcccagagggacgccaccaaggccttcagcgactaccagtggcttgacgacaccgtcggtctcatcttccactccttccccctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49173 - DNA, 359 bp, Artificial
  Mutation in BnaC.FAD2.a introduced by TALE nuclease pair BnFAD2_T05
cctctcctccctcaccctttctcctacttcgcctggcctctctactgggcctgccaaggctgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccattggtacgcaccgtgatgttaacggtgcaggtcactcttggctggccggtatacttag

SEQ ID NO: 49174 - DNA, 471 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggctggaccgtctccagcgcctgcttgccaccatcgtggctggcgatggcccccacctgctccggggtcaagccgtgggcctggcacagcaccggcaacagccgctggagacgaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49175 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49176 - DNA, 323 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttttacttag

SEQ ID NO: 49177 - DNA, 352 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49178 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatcgcccacgaatgcgcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgttcagttcacgctcggctggcctttgtacttag

SEQ ID NO: 49179 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggccttgtacttag

SEQ ID NO: 49180 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacaccttcagcggctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49181 - DNA, 319 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49182 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49183 - DNA, 392 bp, Artificial
  Mutation in BnaC.FAD2.a introduced by TALE nuclease pair BnFAD2_T05
cctctcctccctcaccctctcccctacttcgcctggcctctctactgggcctgccaagggtgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49184 - DNA, 407 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccattgctggcgatggccaccacctgctggggggtcaagccgtgggcctggcacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccgttgtacttag

SEQ ID NO: 49185 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcacttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49186 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtccgtag

SEQ ID NO: 49187 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacgctggctccctcgagagagacgaagtgtttgtccccaagaagaagtcagacatcaagtggtacggcaagtacctcaacaaccctttgggacgcaccgtgatgttaacggttcagttcactctcggctggccttttgtacttag

SEQ ID NO: 49188 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 49189 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49190 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtacccaagaagaaatccgacatcaagtggtacggaaagtacctcaacaacccgctaggacgcacggtgatgctaaccgtccagttcacgctcggctggcctttgtacttag

SEQ ID NO: 49191 - DNA, 356 bp, Artificial
  Mutation in BnaC.FAD2.a introduced by TALE nuclease pair BnFAD2_T05
ccgctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49192 - DNA, 287 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcccttacttctcctggaagtacagtcatcgacgccaccattccaacactggctccctcgagagagacgaagtgtttgtccccaagaagaagtcagacatcaagtggtatggcaagtacctcaacaaccctttgggacgcaccgtgatgttaacggttcagttcactctcggctggcctttgtacttag

SEQ ID NO: 49193 - DNA, 359 bp, Artificial
  Mutation in BnaC.FAD2.a introduced by TALE nuclease pair BnFAD2_T05
cctctcctcctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49194 - DNA, 403 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcgggtttcgccacctctggtggtggccatcgccagcaatggcggtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcatttcactctcggctggcctttgtacttag

SEQ ID NO: 49195 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 49196 - DNA, 362 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49197 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggcttcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49198 - DNA, 358 bp, Artificial
  Mutation in BnaC.FAD2.a introduced by TALE nuclease pair BnFAD2_T05
cctctcctccctcaccctctcacctacttcgcctggcaaccctactgggcctgccaagggtgcgtcctaaacggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49199 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 49200 - DNA, 329 bp, Artificial
  Mutation in BnaC.FAD2.a introduced by TALE nuclease pair BnFAD2_T05
cctctcctccctcaccctttcccttacctcgcctggcctctctactgggcctgccaagggtgcgtcctaaccggcgtctgggtcatagcccacgagtgcggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49201 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggggatgctaaccgtcccgttcacgctcggctggcctttgtacttag

SEQ ID NO: 49202 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccccaccacgccttcatcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 49203 - DNA, 349 bp, Artificial
  Mutation in BnaC.FAD2.a introduced by TALE nuclease pair BnFAD2_T05
cctcctccctcaccctctctcctacttcgcctggcctctctactgggcctgccaagggtgcgtcctaaccggcgtctgggtcatagcccacgagacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49204 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 49205 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49206 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacggttcagttcactctcggctggcctttgtacttag

SEQ ID NO: 49207 - DNA, 351 bp, Artificial
  Mutation in BnaC.FAD2.a introduced by TALE nuclease pair BnFAD2_T05
cctctcctccctcaccctctctcctactccgtctggcctctctactgggcctgccaagggcgcgccctaaccggcgtctgggtcatagcccacgagacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaccccgctaggacgcacggtgatgctacccctccagttcccgctcggctggcctttgtacttag

SEQ ID NO: 49208 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgatgatggaagtaccagtggcttgacgacaccgtcggtctcatcttccactccttccccctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 49209 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49210 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 49211 - DNA, 357 bp, Artificial
  Mutation in BnaC.FAD2.a introduced by TALE nuclease pair BnFAD2_T05
cctctcctccctcaccctctctcctacttcgtctggcttctctactcttcctcccaagtgcgcgccctaaccagcgtctgggtcatagcacaccagtgcaccacgccttcagcgactacccgtggcttgacgacaccgtcggtctcatcttccactccttcctcctcctcccttacttctcctgtaagtacagtcatcgacgccaccattccaacactggctccctcgagagagacgaagtgtttgtccccaagaagaagtcagacatcaagtggcccgtctagtcgcccaacacccctgatggacgtaccggacagctaacggttcagctcactctcggctggcctttgtacttag

SEQ ID NO: 49212 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagatatcaagtggtacggcaagtacctcaacaaccctttgggacgcaccgtgatgttaacggttcagttcactctcggctggcctttgtacttag

SEQ ID NO: 49213 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttgcttctcctggaagtacagtcatcgacgccaccattccaacactggctccctcgagagagacgaagtgtttgtccccaagaagaagtcagacatcaagtggtacggcaagtacctcaacaaccctttgggacgcaccgtaatgttaacggttcagtccactctcggctggcctttgtacttag

SEQ ID NO: 49214 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 49215 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49216 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49217 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49218 - DNA, 333 bp, Artificial
  Mutation in BnaC.FAD2.a introduced by TALE nuclease pair BnFAD2_T05
cctctcctccctcaccctctctcctacttcgcctggcctctctactaggcctgagcaggttattgctggggggtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49219 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagttgcttgacgacaccgtcggtctcatcttccactccttcctcctcgtcccttacttctcctggaagtacagtcatcgacgccaccattccaccactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49220 - DNA, 331 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaaaccgacatcaagtggtaaggcaagtacctcaacaaccctgtgggacgcaccgtgatgttaacggttcagttcactctcggctggcctttgtacttag

SEQ ID NO: 49221 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtccttag

SEQ ID NO: 49222 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttccgcgactaccagtggcttgacgacaccgtcggcctcatcttccactccttcctcctcgtcccttacttctcctggaagtacagtcatcgacgccaccattccaacactggctccctcgagagagacgaagtgtttgtccccaggaagaagtcagacatcaagtcgtacggcaagtacctcaacacccctttgggacgcaccgtgatgttaaccgttcagttcactctcggctgccctttgtacttag

SEQ ID NO: 49223 - DNA, 358 bp, Artificial
  Mutation in BnaC.FAD2.a introduced by TALE nuclease pair BnFAD2_T05
cctctcctcctcaccctctcccttacctcgcctggcccctctactgggcctgccaaggctgcgtcctaacgggcgtctgggtcatcgcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtaaggcaagtacctcaacaaccctttgggacgcaccgtgatgttaacggttcggttgactctcggctggcctttgtacttag

SEQ ID NO: 49224 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaaatacctcaacaaccctttgggacgcaccgtgatgtgaacggttcagttcactctcggctggcctttgtacttag

SEQ ID NO: 49225 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacgccaagtacctcaacaaccctttgggacgcaccgtgatgttaacggttcagttcactctcggctggcctttgtacttag

SEQ ID NO: 49226 - DNA, 418 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttaaaacgaaaggcccagtcttccgactgagcctttcgttttatttgatgcctggcagttcccgaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49227 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtcccaagaagaagtcagacatcaagtggtacggcaagtacctcaacaaccctttgggacgcaccgtgatgttaacggttcagttcactctcggctggcctttgtacttag

SEQ ID NO: 49228 - DNA, 357 bp, Artificial
  Mutation in BnaC.FAD2.a introduced by TALE nuclease pair BnFAD2_T05
cctctcctccctaaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49229 - DNA, 346 bp, Artificial
  Mutation in BnaC.FAD2.a introduced by TALE nuclease pair BnFAD2_T05
cctctcctccctcaccctctctcctacttcgcctggccacactactgggcctgccaagggtgcgccctaaccggcgtctgggtcatcgcccacgagttcagcgactaccagtggcttgacgacaccgtcgggctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccggtgggacgcaccgggaggttaacggttcaggtcactctcggctggcctttgtacttag

SEQ ID NO: 49230 - DNA, 359 bp, Artificial
  Mutation in BnaC.FAD2.a introduced by TALE nuclease pair BnFAD2_T05
cctctcctccctcaccctctcttctccttcgcctggcctctctactgggcctgccaagggtgcgccctaaccggcctctgggtcatagcccacgcgtgcggaccacgccttcagcgactaccagtggcttgacgacaccgtcggtctcatcttccactccttcctcctcgtccattacttctcctggaagtacagtcatcgacgccaccattccaacactggctccctcgagagagacgaagtgtttgtccccaagaagaagtcagacatcaagtggtacggcaagtacctcagcaaccgttagagacgcaccagaatgttaacggttcaattcactctcggctggcctttgtacttag

SEQ ID NO: 49231 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49232 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgaccacaccgtcggtctcatcttccactccttcctcctcgtcccttacttctcctggaagtacagtcatcgacgccaccattccaacacttgctccctcgagagagacgaagtgtttgtccccaagaagaagtcagacatcaagtggtacggcaagtacctcagcaaccctttgggacgcaccgtgatgttaacggttcatttcactctcggctggcctttgtacttag

SEQ ID NO: 49233 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 49234 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49235 - DNA, 345 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgaggctaaccgtccagttcacgctcggctggcctttgtacttagc

SEQ ID NO: 49236 - DNA, 361 bp, Artificial
  Mutation in BnaC.FAD2.a introduced by TALE nuclease pair BnFAD2_T05
cctctcctcctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49237 - DNA, 331 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtcttggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 49238 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactatcggctggcctttgtacttag

SEQ ID NO: 49239 - DNA, 418 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttaaaacgaaaggcccagtcttccgactgagcctttcgttttatttgatgcctggcagttcccgaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49240 - DNA, 359 bp, Artificial
  Mutation in BnaC.FAD2.a introduced by TALE nuclease pair BnFAD2_T05
cctctcctccctcaccctctcacctacttcgcctggactctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 49241 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctgtgggacgcaccgggaggttaacggttcaggtcactctcggctggcctttgtacttag

SEQ ID NO: 49242 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagtgtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49243 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatctacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 49244 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaacctgcgtctgggtcataacccaccacgccttcagcgactaccagtggcttgacgacaccgtcggtctcatcttccactccttcctcctcgtcccttacttctcctggaagtacattcatcgacgccaccattccaacactggctccctcgagagagacgaagtgtttgtccccaagaagaagtcagacatcaagtggtacggcaagtacctcaacaaccctttgggaggcaccgtgatgttaacggttcagttctctctgggctggcctttgtccttag

SEQ ID NO: 49245 - DNA, 358 bp, Artificial
  Mutation in BnaC.FAD2.a introduced by TALE nuclease pair BnFAD2_T05
cctctcctccctcaccctctcccttaccccgccttgcccccctactgggcctgccaaggctgcgtcctaacgagcctctgggtcatcgcccactaatgccaccacgccttcagcgactaccagtggcttgacggcaacgtcggtctcatctttcactccttcctcctcgtcccttacttctcctgggagtacagtcatcgacgccaccattccaacactggctccctcgagagagacgaagtgtgtgtccccaagaagaagtcaaacatcgagtggtacggcgagtacctcaacaaccgtgtggaacgcaccgtgatttttccggttcagttcactctcggctggcctttgtacttag

SEQ ID NO: 49246 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgatgatggaagtaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaaaccgacatcaagtggtacggaaagtacctcaacaacccgctaggacgcacggggtggctaaccgtccagtccacgctcggctggcctttgtccttag

SEQ ID NO: 49247 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 49248 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49249 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcatgagtacttag

SEQ ID NO: 49250 - DNA, 343 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctgcctgtgtacttag

SEQ ID NO: 49251 - DNA, 396 bp, Artificial
  Mutation in BnaC.FAD2.a introduced by TALE nuclease pair BnFAD2_T05
ccactcctccctcaccctctctcctacttcgcctggcctctctactgggcctgccaagggtgcgtcctaaccggcgtctgggtcatagcccacgagtggtggcaatcgccagcaatggcggtggcaagcaggcgctggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49252 - DNA, 358 bp, Artificial
  Mutation in BnaC.FAD2.a introduced by TALE nuclease pair BnFAD2_T05
cctctcctccctcaccctctctcctacttcgcctgccctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccatttcacgctcggctggcctttgtacttag

SEQ ID NO: 49253 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctctgggacgccccgtgatgtaaacggttcagttcactctcggctggcctttgtacttag

SEQ ID NO: 49254 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49255 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacatcaacaaccctttgggacgcacggtgatgctaaccgtccagttcacgctcggctggcctttgtacttag

SEQ ID NO: 49256 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagatacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49257 - DNA, 409 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggtggcaagcaggcgctggagacggtccagcgcctgcttgccgccatcgcctaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49258 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttatcggttcagttcactctcggctggcctttgtacttag

SEQ ID NO: 49259 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccaggtcacgctcggctggccttagtacttag

SEQ ID NO: 49260 - DNA, 440 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagaagactgagcctttcgttttatttgatgcctggcacagcaccggcaacagccgctggaccgtctccagcgcctgcttgccaccgccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49261 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49262 - DNA, 392 bp, Artificial
  Mutation in BnaC.FAD2.a introduced by TALE nuclease pair BnFAD2_T05
cctctcctccctcaccctctctcctacttcgcctggcctctctaatgggcctgccaagggtgcgtcctaaccggcgtctgggtcatagcccacgagtgcttctagctgataaattcatgccggagagggtggccaccacgccttcagcgacgaccagtggcttgacgacaccgtcggtctcatcttccactccttcctcctcgtcccttacttctcctggaagtacagtcatcgacgccaccattccaacacgggctccctcgagagagacgaagtgtttgtccccaagaagaagtcagacatcaagtggtacggcaagtacctcaacaaccctttgggacgcaccgggatgttaacggttcagttcactctcggctggcctgtgtacttag

SEQ ID NO: 49263 - DNA, 394 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagcattgctcatcaatttgttgcaacgaacaggtcactatccaccacgccttcagcgactaccagtggcttgacgacaccgtcggtctcatcttccactccttcctcctcgtcccttacttctcctggaagtacagtcatcgacgccaccattccatcactggctccctcgagagagacgaagtgtttgtccccaagaagaaatccgacatcaagtggtacggaaagtacctcaacaacccgccaggacgcacggtgatgctaaccggccagttcacgctcgtctggcctttgtacttag

SEQ ID NO: 49264 - DNA, 358 bp, Artificial
  Mutation in BnaC.FAD2.a introduced by TALE nuclease pair BnFAD2_T05
cctctcctccctcaccctctttcctacttcgcctggctcccctactgggcctgccaagggcgcgtcctaaccgccgtctgggtaatagcccacgagtgccaccacgctttcagcgactaccagtggcttgacgacaccgtcggtctcatcttccactccttcctccccgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49265 - DNA, 355 bp, Artificial
  Mutation in BnaC.FAD2.a introduced by TALE nuclease pair BnFAD2_T05
cctctcctccctcaccctctcacctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49266 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggcttgacgacaccgtcggtctcatcttccactccttcctcctcgtccctttcttctcctggaagtacagtcatcgacgcctccattccaacactcgctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 49267 - DNA, 323 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtccgggtcatagcccacgagtgcggccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49268 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcctttgtacttag

SEQ ID NO: 49269 - DNA, 454 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcggcgaccccccagcaggtggtggccatcgccagcaataatggtggcaagcaggcgctggagacggtccagcggctgttgccggtgctgtgccaggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49270 - DNA, 396 bp, Artificial
  Mutation in BnaC.FAD2.a introduced by TALE nuclease pair BnFAD2_T05
cctctcctccctcaccctctctcctacttcgcctggcccctctactgggcctgccaagggtgcgtcctaaccggcgtctgggtcatagcccacgagtggtggccatcgccagcaatggcggtggcaagcaggcgctggaccccgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49271 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaactgttcagttcactctcggctggcctttgtacttag

SEQ ID NO: 49272 - DNA, 392 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49273 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaaggctgcgtcctaaccggcctctgggtcatagcccacgagtgccaccacgccttcagcgactaccagcggcttcacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49274 - DNA, 360 bp, Artificial
  Mutation in BnaC.FAD2.a introduced by TALE nuclease pair BnFAD2_T05
cctctcctccctcaccctctcacctacttcgcctggcctccctactgggcctgccaaggctgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgggatggtaacggttcagttcactcgcggctggcctttgtacttag

SEQ ID NO: 49275 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 49276 - DNA, 351 bp, Artificial
  Mutation in BnaC.FAD2.a introduced by TALE nuclease pair BnFAD2_T05
cctctcctccctcaccctctctcctacttcgcttggcctctctactgggcctgccaagggtgcgtcctaaccggcgtctgggtcatagcccacgagtcgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49277 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggcgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 49278 - DNA, 355 bp, Artificial
  Mutation in BnaC.FAD2.a introduced by TALE nuclease pair BnFAD2_T05
cctctcctccccaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49279 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatcccacagcaagtggtacggaaagtaccgcaacaacccgctaggacgcgcggtgaggctaaccgtccagttcacgcttggctggcctttgtacttag

SEQ ID NO: 49280 - DNA, 471 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggctggaccgtctccagcgcctgcttgccaccatcgtggctggcgatggccaccacctgctccggggtcaagccgtgggcctggcacagcaccggcaacagccgctggagacgaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49281 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgatgtgtttgtccccaagaagaagtcagacatcaagtggtacggcaagtacctcaacaaccctttgggacgcaccgtgaggttaacggttcagttcactctcggctggcctttgtacttag

SEQ ID NO: 49282 - DNA, 357 bp, Artificial
  Mutation in BnaC.FAD2.a introduced by TALE nuclease pair BnFAD2_T05
cctctcctcctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattacaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49283 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 49284 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgactaccagtggcttgacgacaccgtcggtctcatcttccactccttcctcctcgtcccttacttctcctggaagtacagtcatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49285 - DNA, 361 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagacaggcagaaatgtcgtatgccactagcagctgctagaagacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggactttgtacttag

SEQ ID NO: 49286 - DNA, 357 bp, Artificial
  Mutation in BnaC.FAD2.a introduced by TALE nuclease pair BnFAD2_T05
cctctcctccctcaccctctctcctacttcgcctggcctccctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagcccgttgggacgcaccgtgatgttaacggttcagttcactcgcggctggcctttgtacttag

SEQ ID NO: 49287 - DNA, 354 bp, Artificial
  Mutation in BnaC.FAD2.a introduced by TALE nuclease pair BnFAD2_T05
cctctcctccctcaccctctctcctacttcgcctttcctctcttctgggcctgccaagggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttttacttag

SEQ ID NO: 49288 - DNA, 355 bp, Artificial
  Mutation in BnaC.FAD2.a introduced by TALE nuclease pair BnFAD2_T05
cctctcctccctcaccctctcccttacctcgcctggcccctctactggacctaccacggctgcgtcctaaccggcgtatgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatggtaacggttcagttcactctcggctggcctttgtacttag

SEQ ID NO: 49289 - DNA, 348 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgttcagcgattaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49290 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgagaccgtcgggcgcatcttccactccttcctcctcgtcccttacttctcctggaagtacagccatcgacgccaccattccaacaccggatccctcgagagggatgaagtgttcgtccccaagaagaagtcagacatcaagtggtacggcaggtacgtcaacgggcctttgggaggggccgtgatgttaacggttcagttcagtctcggctggcctttgtacgtag

SEQ ID NO: 49291 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 49292 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49293 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 49294 - DNA, 357 bp, Artificial
  Mutation in BnaC.FAD2.a introduced by TALE nuclease pair BnFAD2_T05
cctctcctccctccctctcccttacctcgcctggcccctctactgggcctgccaagggtgcgtcctaaccggcgtctgggtcatagcccacgagtgccaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49295 - DNA, 346 bp, Artificial
  Mutation in BnaC.FAD2.a introduced by TALE nuclease pair BnFAD2_T05
cctctgctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49296 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggactttgtacttag

SEQ ID NO: 49297 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggcccccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccttttgtgacgcaccgtgatgttaacggttcagttcactctcggctggcctttgtacttag

SEQ ID NO: 49298 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgtcgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49299 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttttacttag

SEQ ID NO: 49300 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49301 - DNA, 352 bp, Artificial
  Mutation in BnaC.FAD2.a introduced by TALE nuclease pair BnFAD2_T05
cctctcctccctcaccctctctcctacttcgcctggcttctctgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtatggcaagtacctcaacaaccctttgggacgcaccgtgatgttaacggttcagttcactctcggctggcctttgtacttag

SEQ ID NO: 49302 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccgtcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 49303 - DNA, 358 bp, Artificial
  Mutation in BnaC.FAD2.a introduced by TALE nuclease pair BnFAD2_T05
cctctcctccctcaccctctctcctacttcgcctggcctctctactgagcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaggcagacatcaagtggtacggcaagttcctcaacaaccgttagggacgtaccgggatgtgaacggttcagttcactcgcggctggcctttgtacttag

SEQ ID NO: 49304 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatggtaacggttcagttcactctcggctggcctttgtacttag

SEQ ID NO: 49305 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 49306 - DNA, 344 bp, Artificial
  Mutation in BnaC.FAD2.a introduced by TALE nuclease pair BnFAD2_T05
cctctcctccctcaccctctctcctacttcgcctggcctctctcctgggcctgccaagggcgcgtcctaaccggcgtctgggtcatagcccacgagtgcgtttgtccactggcttgacgacaccgtcggcctcatcttccactccttcctcctcttcccttacttctcctggaagtacagtcatcgacgccaccatttcaacactggctccctcgagagagacgaagtgtttgtccccaagaagaagtcagacatcaagtggtacggcaagtacctcagcaaccctttgggacgcagcgtgattttaacggttcagttcactctcggctggcctttgtgcttag

SEQ ID NO: 49307 - DNA, 363 bp, Artificial
  Mutation in BnaC.FAD2.a introduced by TALE nuclease pair BnFAD2_T05
cctctcctccctcaccctctcccttacctcgcctggaccctcaactgggcctgccaagggtgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggtgcagttcactctcggcgggcctttgtacgtag

SEQ ID NO: 49308 - DNA, 340 bp, Artificial
  Mutation in BnaC.FAD2.a introduced by TALE nuclease pair BnFAD2_T05
cctctcctccctcaccctatatcctacttcgcctcgcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcaggtcactctcggctggcctttggacttag

SEQ ID NO: 49309 - DNA, 358 bp, Artificial
  Mutation in BnaC.FAD2.a introduced by TALE nuclease pair BnFAD2_T05
cctctcctccctcaccctctctcctacttcttctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtttttgtccccaagaagaagtcagacatcaagtggtccggcaagtcccccaacacccctgtgggacgcaccgtgatgttaacgcttccgttccctctcggctggcctttgtacttag

SEQ ID NO: 49310 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgggaggttaacggttcagttcactctcggctggcctttgtacttag

SEQ ID NO: 49311 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgggatgttaacggttcagttcactcgcggctggcctttacacttag

SEQ ID NO: 49312 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49313 - DNA, 360 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcggcaccacgccttcagcgactaccagtggcttgacgaccccgtcggtctcatcttccactccttcctcctcgtcccttacttctcctggaagtacagtcatcgacgccaccattccaacgctggctccctcgagagagacgaagtgttggtccccaagaagaagtcagacatcaagtggtacggcaagtacctcagcagccctttgggacgcaccgtgatgttaacggttcggttcgctgtcggctggccgttgtgctgag

SEQ ID NO: 49314 - DNA, 356 bp, Artificial
  Mutation in BnaC.FAD2.a introduced by TALE nuclease pair BnFAD2_T05
cctctcctccctcaccctctctcctacttcgcctgcactctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcatgtacctcaacaacccttgtggacgcacggtgatgttaacggcgcatttcactctcggctggcctttgtacttag

SEQ ID NO: 49315 - DNA, 358 bp, Artificial
  Mutation in BnaC.FAD2.a introduced by TALE nuclease pair BnFAD2_T05
cctctcctccctcaccctctctcctacttcgcctgccctctctactgggcctgccaagggtgcgtcctaaccggcgtctgggtcatcgcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctgtcctttgtacttag

SEQ ID NO: 49316 - DNA, 357 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgactaccagtggcttgacgacaccgtcggtctcatcttacactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49317 - DNA, 353 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49318 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgcaaggacgcacggtgatgctaaccgtccagttcacgctcggctggcctttgtgcttag

SEQ ID NO: 49319 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggccaccacgccttcagcgactaccagtggcttgacgacaccgtcggtctcatcttccactccttcctcctcgtcccttacttctcctggaaatacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 49320 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgttctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaattcactcgcggcgggcctttgtacttag

SEQ ID NO: 49321 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49322 - DNA, 360 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcactctcggctggcctttgtacttag

SEQ ID NO: 49323 - DNA, 355 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49324 - DNA, 358 bp, Artificial
  Mutation in BnaC.FAD2.a introduced by TALE nuclease pair BnFAD2_T05
cctctcctccctcaccctcgctcctacttcgcctggcccctctactcggcctgccaagggtgcgtcctaaacggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagttcctcaacaagccttagggacgtatagggatcttaccggttcagttcactctcggctggcctttgtacttat

SEQ ID NO: 49325 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggggcagtgcacgcgcggctggactttgtactgag

SEQ ID NO: 49326 - DNA, 347 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccaactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49327 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgtgacgccccgtgatgttaacggttcagttcactctcggctggcctttgtacttag

SEQ ID NO: 49328 - DNA, 358 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49329 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagaacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49330 - DNA, 355 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacggccaccacgccttcagcgactaccagtggcttgacgacaccgtcggtctcatcttccactccttcctcctcgtcccttacttctcctggaagcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49331 - DNA, 358 bp, Artificial
  Mutation in BnaC.FAD2.a introduced by TALE nuclease pair BnFAD2_T05
cctctcctccctcaccctctctcctacttcgcctggactctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 49332 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaaggatgcgtgctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcccggtgatgcaaaccgtccagttcacgctcggctggcctttgtacttag

SEQ ID NO: 49333 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49334 - DNA, 358 bp, Artificial
  Mutation in BnaC.FAD2.a introduced by TALE nuclease pair BnFAD2_T05
cctctcctccctcaccctgtctcctacttcgcctggcctctctcctcggcctgccaaggatgcgtcctaaccggcgtctgggtcatagcccacgagtgccaccacgccttcagcgactaccagtggcttgacgacaccgtcggtctcatcttccactccttcctcctcgtcccttacttctcctgggagtacagtcatcgacgccaccattcaaacactggctccatcgagagagacgaagtgtttgtccccaagaagaagtcagacatcaagtggtacggcaagtacctcaacatgcctttgggacgcaccgtggtgttaacggttcagttcacgctcggctggcctttgtgcttag

SEQ ID NO: 49335 - DNA, 465 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccatcgccagcaatattggtggcaagcaggcgctggagacggtccaggcgctgttgccggtgctgtgccaggcccacggcttgacccccagcaggtggtggccatccaccacgccttcagcgactaccagtggcttgacgacaccgtcggtctcatctgccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggggatgctaaccgtccagttcacgctcggctggccttgtacttag

SEQ ID NO: 49336 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatatcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49337 - DNA, 344 bp, Artificial
  Mutation in BnaC.FAD2.a introduced by TALE nuclease pair BnFAD2_T05
cctctcctccctcaccctatctcctacttcgcctgccctctctactgggcctgccaagggtgcgtcctaaccggcgtctgggtcatcgcccacgagtgcgtttgtccactggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacagccctttgtgacgcaccgtgatggtaacggttcagtgcactctcggcgggcctgtgtacttag

SEQ ID NO: 49338 - DNA, 363 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49339 - DNA, 344 bp, Artificial
  Mutation in BnaC.FAD2.a introduced by TALE nuclease pair BnFAD2_T05
cctctcctccctcaccctctctcctacttcgcctggcaactctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 49340 - DNA, 471 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctggggggtcaagccgtgggcctggcacagcaccggcaacagcgcaatgacattcttgcaggtatggccaccacctggggggtcaagccgtgggcctggcacagcaccggcaacagccgctggaccgtctccagcgcctgcttgcccaccacgccttcagcgactcccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49341 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccgcgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaagcctttgggacgcaccgtgatgttaacggttcagttcactctcggctggcctttgtacttag

SEQ ID NO: 49342 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgtgtcatagcccacgagtgcggccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49343 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 49344 - DNA, 394 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcgacaaacaacagataaaacgaaaggcccagtcttcccaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49345 - DNA, 419 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggtatcttcgagccagccacgatcgacattgatctggcacagcaccggatggtttgacgacaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49346 - DNA, 403 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcgggtttcgccacctctggtggtggccatcgccagcaatggcggtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacacaccgtgatgttaacggttcagttcactctcggctggcctttgtacttag

SEQ ID NO: 49347 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggcttgacgacaccgtcggtctcctcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 49348 - DNA, 346 bp, Artificial
  Mutation in BnaC.FAD2.a introduced by TALE nuclease pair BnFAD2_T05
cctctcctccctcaccctctcccctacttcgcctggcctctctactgggcctgccaagggtgcgtcctaccaggcgtctgggtcatagcccacgagttcagcgactaccagtggcttgacgacaccgtcggtctcatcttccactccttcctcctcttcccttacttctcctggaagtacagtcatcgacgccaccattccaacactggctccctcgagagagacgaagtgtttgtccccaagaagaagtcagacatcaagtggtacggcaattgcctcaacaacccgttgggaagcaccgtgaggttaacggttcagttcactctcggctggcctttgtacttag

SEQ ID NO: 49349 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgccctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49350 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 49351 - DNA, 364 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtcttggtcatagcccacgatggcggcaagaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 49352 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 49353 - DNA, 355 bp, Artificial
  Mutation in BnaC.FAD2.a introduced by TALE nuclease pair BnFAD2_T05
cctctcctccctcaccctgtctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaactacctcaacaaccctttgggacgcaccgtgatgttaacggttcagttcactctcggctggcctttgtacttag

SEQ ID NO: 49354 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcacgctcggctggcctttgtacttag

SEQ ID NO: 49355 - DNA, 340 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49356 - DNA, 418 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagttaaaacgaaaggcccagtcttccgactgagcctttcgttttatttgatgcctggcagttcccgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49357 - DNA, 363 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49358 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49359 - DNA, 340 bp, Artificial
  Mutation in BnaC.FAD2.a introduced by TALE nuclease pair BnFAD2_T05
cctctcctccctcaccctctctcctacttcgcttggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 49360 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccacaagaagaagtcagacatcaagtggtacggcaagtacctcaacaaccctatgggacgcaccgtgatgttaacggttcagttcactctcggctggcctttgtacttag

SEQ ID NO: 49361 - DNA, 280 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttggacttag

SEQ ID NO: 49362 - DNA, 363 bp, Artificial
  Mutation in BnaC.FAD2.a introduced by TALE nuclease pair BnFAD2_T05
cctctcctccctcaccctctctcctacttcgcctggcatctctactgggcctgccaagggtgcgtcctaaccggcgtctgggtcatagcccacgagtgcggggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49363 - DNA, 357 bp, Artificial
  Mutation in BnaC.FAD2.a introduced by TALE nuclease pair BnFAD2_T05
cctctcctccctcaccctctctcctacttcgcctggcatctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcactctcggctggcctttgtacttag

SEQ ID NO: 49364 - DNA, 359 bp, Artificial
  Mutation in BnaC.FAD2.a introduced by TALE nuclease pair BnFAD2_T05
cctctcctccctcaccctatctcctacttcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49365 - DNA, 356 bp, Artificial
  Mutation in BnaC.FAD2.a introduced by TALE nuclease pair BnFAD2_T05
cctctcctccctcaccctctctcctacttcgcctggcctctctaatgggcctgccaagggtgcgtcctaaccggcgtctgggtcatagcccacgagtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaaggggtacggcaagtacctcaacaacccgttgggacgcaccgggatgttaacggttcaggtcacgctcggctggcatgtgtacttag

SEQ ID NO: 49366 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49367 - DNA, 349 bp, Artificial
  Mutation in BnaC.FAD2.a introduced by TALE nuclease pair BnFAD2_T05
cctctcctccctcaccctctcccttacctcgcctggcccctctactgggcctgcaaagggtgcgtcctaaccggcgtctgggtcatagcccaccacgctttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacaaccctttggggcgcaccgtgatgttaacggttcagttctctctcggctgtccgttgtacttag

SEQ ID NO: 49368 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49369 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49370 - DNA, 355 bp, Artificial
  Mutation in BnaC.FAD2.a introduced by TALE nuclease pair BnFAD2_T05
cctctcctccctcaccctctcacttacctcgcctggcccctctactgggcctgccaagggtgcgtcctaaccggcgtctgggtcatagcccacgagtaccacgccttcagcgactaccagtggcttgacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 49371 - DNA, 398 bp, Artificial
  Mutation in BnaC.FAD2.a introduced by TALE nuclease pair BnFAD2_T05
cctctcctccctcaccctgtctcctacttcgcctggctcctccactcggcctgccaagggtgcgtcctaaccggcgtctgggtcatagcccacgagtgtcgggtttcggcaggtggtggctatcgccagcaatggcggggaccacaccctcagcgactaccagtggcttgacgacaccgtcggtctcatcttccactccttccttctcgtcccttacttcccctggaaggacagtcatcgacgccaccattccaacactggcgccctcgagagagacgaagtggttgtccccaagaagaagtcagacatgaagtggaacgggaagtacctcaagaaccctgtgggacgcaccgggaggttaaccgttcaggtgactcccggctgccctgagtgcttag

SEQ ID NO: 49372 - DNA, 348 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtaccccaacaacccggtagggcgcacggggaagctaaccctccagttcacgctcggctggcctttgtacttag

SEQ ID NO: 49373 - DNA, 331 bp, Artificial
  Mutation in BnaC.FAD2.a introduced by TALE nuclease pair BnFAD2_T05
cctctcctccctcacccgttcacctacttcgcctggcctctctcctgggcctgccaagggtgcgtcccaacaggcgtctgggtcagcgactaccagtggcttgacgacaccgtcgatctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgtaaacgtttcagttcacgctcggctggcctttgtacttag

SEQ ID NO: 49374 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49375 - DNA, 362 bp, Artificial
  Mutation in BnaC.FAD2.a introduced by TALE nuclease pair BnFAD2_T05
cctctcctccctcaccctctctcctacttcgcctggcatctctactgggcctgccaagggtgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacacgttgggacgcaccgtgatgttaacggttcatttcactctcggctggcctttgtacttag

SEQ ID NO: 49376 - DNA, 467 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccatcgccagcaatattggtggcaagcaggcgctggagacggtccagcggctgttgccggtgctgtgccaggcccacggcttgaccccccagcaggtggtggccatccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49377 - DNA, 401 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccatcgccagccacgatggcggcaaacagccgctggacaccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 49378 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcacgtggtacggaaagtacctcaacaacccgctaggacgcacggtgatgctaaccctccagttcccgctaggatggccttagtactgag

SEQ ID NO: 49379 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49380 - DNA, 356 bp, Artificial
  Mutation in BnaC.FAD2.a introduced by TALE nuclease pair BnFAD2_T05
cctctcctccctcaccctctctcctacttcgtctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 49381 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 49382 - DNA, 352 bp, Artificial
  Mutation in BnaC.FAD2.a introduced by TALE nuclease pair BnFAD2_T05
cctctcctccctcaccctctcccttacctcgcctggccactctactgggcctgccaaggctgcgtcctaaccggcgtctgggtcatagcccaccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49383 - DNA, 435 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggcttgacgacaccgtcggtctcatcttccactccttcctcctcgtcccttacttcgcctggaagtacagtcagcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctgagtacttag

SEQ ID NO: 49384 - DNA, 328 bp, Artificial
  Mutation in BnaC.FAD2.a introduced by TALE nuclease pair BnFAD2_T05
cctctcctccctcaccctctctcctacttcgcctggcctctctgctgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgaggttaacggttcagttcactctcggctggcctttgtacttag

SEQ ID NO: 49385 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtaattag

SEQ ID NO: 49386 - DNA, 352 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccgacgtctgggtcacagcccacgaccacgccttcagcgactaccagtggcttcacgacaccgtccgtcgcatcttccactccttcctcctcgtccctgacttctcctggcagtacagtcatcgacgccaccattccaacactagctccctcgagagagacgatgcgtttgtccccaagaagatatcagacatcaagtggcacggcaagtaccgcagcatgcctttgaaacgcaccttgatgttaagacttcaagtgccgcccagctggcctttgtgcttag

SEQ ID NO: 49387 - DNA, 358 bp, Artificial
  Mutation in BnaC.FAD2.a introduced by TALE nuclease pair BnFAD2_T05
cctctcctccctcaccctctctcctacttcgcctggcccctctactgggcctgccaaggctgcgtcctaacgggcctctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49388 - DNA, 349 bp, Artificial
  Mutation in BnaC.FAD2.a introduced by TALE nuclease pair BnFAD2_T05
cctctcctccctcaccctctctcctacttcgcctggcctctctactgggcctgcaaagggtgcgtcctaaccggcgtctgggtcatagcccaccacgctttcagcgactaccagtggcttgacgacaccgtcggtctcatcttccactcctccctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49389 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49390 - DNA, 363 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaacggttcagttcactctcggctggcctttgtacttag

SEQ ID NO: 49391 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgatgatggaagtaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 49392 - DNA, 351 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcttgcctttgtacttag

SEQ ID NO: 49393 - DNA, 349 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49394 - DNA, 287 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgtcccttacttctcctggaagtacagccatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 49395 - DNA, 419 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggtatcttcgagccagccacgatcgacattgatctggcacagcaccggatggtttgactccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49396 - DNA, 471 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcggctggaccgtctccagcgcctgcttgccaccatcgtggctggcgatggccaccccctgctccggggtcaagccgtgggcctggcacagcaccggcaacagccgctcgagacgaaccacgccttcagcgactaccagtggcttgatgacaccgtcggcctcatcttccactccttccccctcgtcccttgcttctccttgaagtacagtcatcgacgccgccattccaacactcgctccctctagatagactaagtgtgtggccccacgaagaaggcagccatcaagtggtacggcaaggtccgcagcatccctttgaggcgcaccttgatgttaacccttcagttgtctcccgtctgtcctctgggcttag

SEQ ID NO: 49397 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatcagacatcaagtggtacggaaagtacctcaacaacccgctaggacgcacggtgatgctaaccgtccagttcacgctcggctggcctttgtacttag

SEQ ID NO: 49398 - DNA, 340 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 49399 - DNA, 371 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtcttcctggcggcggccaccacgccttcagcgactatcagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49400 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgatgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49401 - DNA, 344 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 49402 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggccgttgtacttag

SEQ ID NO: 49403 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctccttgaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49404 - DNA, 359 bp, Artificial
  Mutation in BnaC.FAD2.a introduced by TALE nuclease pair BnFAD2_T05
cctctcctccctcaccctctcccttacctcgcctggcccctctactgggcctgccaagggtgcgtcctaaccggcgtctgggtcatagcccacgagtgccaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49405 - DNA, 354 bp, Artificial
  Mutation in BnaC.FAD2.a introduced by TALE nuclease pair BnFAD2_T05
cctctcctccctcaccctctctcctacttcgcctggcctctctactgggcctgcccaaggtgcgtcctaacccgcgtctgggtcatagcccacgacaccacgccttcagcgactaccagtggcttgacgtcaccatcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgcgaggacgcacggtgatgctaaccgtccagttcactctcggttggccgttgtacttag

SEQ ID NO: 49406 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttagcggttcagttcactctcggctggcctttgtacttag

SEQ ID NO: 49407 - DNA, 465 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccatcgccagcaatattggtggcaagcaggcgctggagacggtgccaggcccacggcttgaccccggagcaggtggtggccatcgccagcaatattggtggcaagcaggaaccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49408 - DNA, 358 bp, Artificial
  Mutation in BnaC.FAD2.a introduced by TALE nuclease pair BnFAD2_T05
cctctcctccctcaccctctctcctacttcgcctggcatctctcctgggcctgccaagggtgcgtcctaaccggcgtctgggtcatagcccacgagtgcgccaccacgccttcagcggataccagtggcttgacgacaccgtcggtctcatcttccactccttcctcctcgtcccttacttctcctggaagtacagtcatcgacaccaccattccaacactggctccctcgagagagacgaagtgtttgtccccaagaagaagtcagacatcaagtggtacggcaagtacctcaacatccctttgggacgcaccgtgatgttaacgtttcagttcactctcggctggcctgtacttag

SEQ ID NO: 49409 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggtgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 49410 - DNA, 355 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaacggttcagttcactctcggctggcctttgtacttag

SEQ ID NO: 49411 - DNA, 349 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49412 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 49413 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactatgggcaggcctttgtacttag

SEQ ID NO: 49414 - DNA, 394 bp, Artificial
  Mutation in BnaC.FAD2.a introduced by TALE nuclease pair BnFAD2_T05
cctctcctccctcaccctctctcctacttcgcctggcctctctaatgggcctgccaagggtgcgtcctaaccggcgtctgggtcatagcccacgagcattgctcatcaatttgttgcaacgaacaggtcactatccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49415 - DNA, 395 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcggccacacagtgatattgatttgctggttacggtgaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49416 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgcattcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttttacttag

SEQ ID NO: 49417 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcgggctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttggcggttcagttcactctcggctggcctttgtgcttag

SEQ ID NO: 49418 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcacccccccttcagcgactaccagtggcttgactacaccctcggtctcaccttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 49419 - DNA, 280 bp, Artificial
  Mutation in BnaC.FAD2.a introduced by TALE nuclease pair BnFAD2_T05
cctctcctccctcaccctctctcctacttcgcctggcctctctaatgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagccatcaagtggtacggcaagtacctcaacaaccctttgggacgcaccgtgatgttaacggttcagttcactctcgggtggcctttgtacttag

SEQ ID NO: 49420 - DNA, 362 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgactaccagtggcttgacgacaccgtcggtctcttcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcacggtgatgttaacggttcagttcacgctcggctggcctttgtacttag

SEQ ID NO: 49421 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacagcaagtggtacggcaagtacctcaacaaccctttgggacgcaccgtgatgttaacggttcagttcactctcggctggcctttgtacttag

SEQ ID NO: 49422 - DNA, 358 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 49423 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtttactctcggctggcctttgtacttag

SEQ ID NO: 49424 - DNA, 435 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 49425 - DNA, 349 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacaaccctttgggacgcaccgtgatgttaacgtttcagttcactctcggctggcctgtgtacttag

SEQ ID NO: 49426 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaatggtgcgtcctaaccggcgtctgggtcatagcccacgagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 49427 - DNA, 346 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgcctccattccaacactggctccctcgagagagacgaagtgtttgtccccaagaagaagtcagacatcaagtggtacggcaattacctcaacaaccctttgggacgcaccgtgatgttaacggttcagttcactctcggcgggcctttgtacttag

SEQ ID NO: 49428 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49429 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagtcaccgacgccaccattccaacactggctccctcgagagagacgaagtgttcgtccccaagaagaagtccgacatcaagtggtacggaaagtacctcaacaacccgctgggacgcacggtgatgttaaccgtccagttcacgctcggctggcctttgtacttag

SEQ ID NO: 49430 - DNA, 346 bp, Artificial
  Mutation in BnaC.FAD2.a introduced by TALE nuclease pair BnFAD2_T05
cctctcctccctcaccctctctcctacttcgcctggcttctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49431 - DNA, 331 bp, Artificial
  Mutation in BnaC.FAD2.a introduced by TALE nuclease pair BnFAD2_T05
cctctcctccctcaccctctctcctacttcgcctggcctctctactggacctgccaagggtgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49432 - DNA, 362 bp, Artificial
  Mutation in BnaC.FAD2.a introduced by TALE nuclease pair BnFAD2_T05
cctctcctccctcaccctctctcctacttcgcctggcctatctactgggcctgccaagggtgcgtcctaaccggcgtctgggtcatagcccacgagtgcgtgcgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49433 - DNA, 435 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggcttgacgacaccgtcggtctcatcttccactccttcctcctcgtcccttacttctcctggaagtacagtcatcgacgcccccattccaacactggctccctcgagagagacgaagtgtttgtccccaagaagaagtcagacatcaagtggtacggcaagtacctcaacagccctttgtgacgcaccgtgatgttaacggttcagttctctctcggctggcctttgtacttag

SEQ ID NO: 49434 - DNA, 460 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgatgttacgcagcagggcagtcgccctaaaacaaagttaaacattatgagggaagcggtgatcgccgaagtatcgactcaactatcagaggtagttggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggctggcctttgtacttag

SEQ ID NO: 49435 - DNA, 357 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgcaccacgccttcagcgactaccagtggctttacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49436 - DNA, 357 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcctagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttctctctcggctggcctttgtacttag

SEQ ID NO: 49437 - DNA, 359 bp, Artificial
  Mutation in BnaC.FAD2.a introduced by TALE nuclease pair BnFAD2_T05
cctctcctccctcaccctctcacctacttcgcctggcctctttactgggcctgccaagggtgcgtcctaaccggcgtctgggtcatagcccacgagtgcgccaccacgccttcagcgactaccagtggcttgacgacgccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaaccttggggacgcaccgtgatgttaactggtcagttcactgtcggctggccgttgaactta

SEQ ID NO: 49438 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49439 - DNA, 323 bp, Artificial
  Mutation in BnaC.FAD2.a introduced by TALE nuclease pair BnFAD2_T05
cctctcctccctcaccctctaccttacctcgcctggcccctctactgggcctgccaagggtgcgtcctaaccggcgtctgggtcatagcccacgagtgcggccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49440 - DNA, 280 bp, Artificial
  Mutation in BnaC.FAD2.a introduced by TALE nuclease pair BnFAD2_T05
cctctcctccctcaccctctcacctacttcgcctggcctctctcatgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 49441 - DNA, 357 bp, Artificial
  Mutation in BnaC.FAD2.a introduced by TALE nuclease pair BnFAD2_T05
cctctcctccctcaccctctcccctacttcgcctggcgtctatactgggcctgccaagggggcgtcctaaccggcgtctgggtcatagcccacgagtgcaccacgccttaagcgactaccaggggcttgacgacaccgtcggtctcaacttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacctttttggtcgctccgttatgttaccggttcagttctctctcggctggcctttgtactcag

SEQ ID NO: 49442 - DNA, 280 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaaccctttgggacgcaccgtgatgttaacggttcagttcactctcggctggcctttgtacttag

SEQ ID NO: 49443 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 49444 - DNA, 333 bp, Artificial
  Mutation in BnaC.FAD2.a introduced by TALE nuclease pair BnFAD2_T05
cctctcctccctcaccctctctcctacttcgcctggcctctctactaggcctgagcaggttattgctggggggtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49445 - DNA, 362 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcggcccaccacgccttcagcgactaccagtggcttgatgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49446 - DNA, 360 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 49447 - DNA, 331 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcgagtacctcaacaaccctttgtgacgcaccgtgatgttaacggttcagttccctctcggctggcctttgtacttag

SEQ ID NO: 49448 - DNA, 328 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctttgggacgcaccgtgaggttaacggttcagttcactctcggctggcctttgtacttag

SEQ ID NO: 49449 - DNA, 354 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgcacttag

SEQ ID NO: 49450 - DNA, 435 bp, Artificial
  Mutation in BnaC.FAD2.a introduced by TALE nuclease pair BnFAD2_T05
cctctcctccctcaccctctcccctactttgcctggcctctctactgggcctgccaagggtgcgtcctaaccggcgtctgggtcatagcccacgagtgcggttgccggtgctgtgccaggcccacggcttgcccccggagcaggtggcggccatcgccagccacgatggcggcaagaaccacgccttcagcgactaccagtggcttgacgacaccgtcggtctcatcttccactccttcctcctcgtcccttacgtctcctggaagtacagtcattgacgccaccagtccaacactggctccctcgagagagacgaagtgtttgtccccaagaagaagtcagacatcaagtggtacggcaagtacctcaacaaccctttgggacgcgccgtgatgttaacggctcagttcactctcggctggcctttgtacttag

SEQ ID NO: 49451 - DNA, 357 bp, Artificial
  Mutation in BnaC.FAD2.a introduced by TALE nuclease pair BnFAD2_T05
ctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49452 - DNA, 328 bp, Artificial
  Mutation in BnaC.FAD2.a introduced by TALE nuclease pair BnFAD2_T05
cctctcctccctcaccctctcacttacctcgcctggcccctctcatgggcctgccaagggtgcgtcctaaccggcgtctgggtcatagcccacgagtgcgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctgtgtacttag

SEQ ID NO: 49453 - DNA, 392 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcttctagctgataaattcatgccggagagggtggccaccacgccttcagcgcctaccagtggcttgacgacaccgtcggtctcatcttccactccttcctcctcgtcccttacttctcctggcagtacagtcatcgacgccaccattcccaccccggctccctcgcgcgagacgacgtgtttgtccccaagcagaagccacacatcaagcggtacggcaagtacctcaacaaccgtctgggacgccccgtgatgttaacggttcagttcactctcggctggcctttgtacttag

SEQ ID NO: 49454 - DNA, 396 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaagcaggcgctggaccacgccttcagcgactaccagtggcttgacgacaccgtaggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcactctcggcgggcctttgtacttag

SEQ ID NO: 49455 - DNA, 359 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 49456 - DNA, 351 bp, Artificial
  Mutation in BnaC.FAD2.a introduced by TALE nuclease pair BnFAD2_T05
cctctcctccctcaccctctcacctacttcgcctggcctctctcctgggcctgccaagggtgcgtcctaaccggcgtctgggtcatagcccacgagacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49457 - DNA, 355 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 49458 - DNA, 364 bp, Artificial
  Mutation in BnaC.FAD2.a introduced by TALE nuclease pair BnFAD2_T05
cctctcctccctcaccctctctcctacttcgcctggcatctctactgggcctgccaagggtgcgtcctaaccggcgtctgggtcatagcccacgagtgcggccgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49459 - DNA, 355 bp, Artificial
  Mutation in BnaC.FAD2.a introduced by TALE nuclease pair BnFAD2_T05
cctctcctccctcaccctctcccttacctcgcctggcccctctactgggcctgccaaggctgcgtcctaaccggcgtctgggtcatagcccacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcacacatcaagtggtccggcaagtacctcaacaaccctgtgggacgcaccgtgatgttaacgcttccgttccctctcggctggcctttgtacttag

SEQ ID NO: 49460 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtttttgtccccaagaagaagtcagacatcaagtggtacggcaagtacctcaacaaccctttgggacgcaccgtgatgttaacggttcagttcactctcggctggcctttgtacttag

SEQ ID NO: 49461 - DNA, 359 bp, Artificial
  Mutation in BnaC.FAD2.a introduced by TALE nuclease pair BnFAD2_T05
cctctcctccctcaccctctcccttacctcgcctggcctctctactgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtgcggaaagtacctcaacaacccgctaggacgcacggtgatgctaaccggccagttcacgctcgtctggcctttgtacttag

SEQ ID NO: 49462 - DNA, 357 bp, Artificial
  Mutation in BnaC.FAD2.a introduced by TALE nuclease pair BnFAD2_T05
cctctcctccctcaccctctatcctacttcgcctggcatctctaatgggcctgccaagggtgcgtcctaaccggcgtctgggtcatagcccacgagtgcaccacgccttaagcgactaccagtggcttgacgacaccgtcggtctcatcttccactccttcctcctcgtcccttacttctcctggaagtacagtcatcgacgccaccattccaacactggctccctcgagagagacgaagtgtttgtccccgagaagatgtcagacatcgagtggtaccgcgaagacctcaagatgcctttggaacgccctgtgatgtaaacgtttcaggtcactctagggagccctttgtacttag

SEQ ID NO: 49463 - DNA, 360 bp, Artificial
  Mutation in BnaC.FAD2.a introduced by TALE nuclease pair BnFAD2_T05
cctctcctccatcaccctctctcctacttcgcctggcctctctactgggcctgccaagggtgcgtcctaaccggcgtctgggtcatagcccacgagtgcgccaccacgccttcagcgactaccagtggcttgacgacaccgtcggtctcatcttccactccttcctcctcgtcccttacttctcctggaagtacagtcgtcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49464 - DNA, 346 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 49465 - DNA, 359 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctgtgtacttag

SEQ ID NO: 49466 - DNA, 351 bp, Artificial
  Mutation in BnaC.FAD2.a introduced by TALE nuclease pair BnFAD2_T05
cctctcctccatcaccctctctcctacttcgcctggcctctctactgggcctgccaagggtgcgtcctaaccggcgtctgggtcatagcccacgagacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49467 - DNA, 359 bp, Artificial
  Mutation in BnaC.FAD2.a introduced by TALE nuclease pair BnFAD2_T05
cctctcctccctcaccctctatcctacttcgcctggcctctctactgggcctgccaagggtgcgtcctaaccggcgtctgggtcatagcccacgagtgcggaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49468 - DNA, 359 bp, Artificial
  Mutation in BnaC.FAD2.a introduced by TALE nuclease pair BnFAD2_T05
cctctcctccctcaccctctctcctacttcgcctggcctctctactgggcccgccaagggtgcgtcctaaccggcgtctgggtcatagcccacgagtgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49469 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgctaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 49470 - DNA, 402 bp, Artificial
  Mutation in BnaC.FAD2.a introduced by TALE nuclease pair BnFAD2_T05
cctctctccctcaccctctttcctacttcgcctggcctctctactgggcctgccaagggtgcgtcctaaccggcgtctgggtcatagcccacgagtgtcgggtttcgccacctctggtggtggccatcgccagcaatggcggtgaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49471 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttat

SEQ ID NO: 49472 - DNA, 358 bp, Artificial
  Mutation in BnaC.FAD2.a introduced by TALE nuclease pair BnFAD2_T05
cctctcctccctcaccctctctcctacttcgcctggcctctctcctgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49473 - DNA, 360 bp, Artificial
  Mutation in BnaC.FAD2.a introduced by TALE nuclease pair BnFAD2_T05
cctctcctccctcaccctctatcctacttcgcctggcctctgtaatgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgatagagacgaagtgtttgtccccaagaagaagtcagacatcaagtggtacggcaattacctcaacaaccctttgggacgcaccgtgatgttaacggttcagttctctctcgtctggcctttgtacttag

SEQ ID NO: 49474 - DNA, 358 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtgcgaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49475 - DNA, 356 bp, Artificial
  Mutation in BnaC.FAD2.a introduced by TALE nuclease pair BnFAD2_T05
cctctcctccctcaccctctctcctacttcgcctggcctctctactgggcctgccaagggtgcgtcctaaccggcgtctgggtcatagcccacgagtcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 49476 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49477 - DNA, 283 bp, Artificial
  Mutation in BnaC.FAD2.b introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49478 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49479 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49480 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49481 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49482 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49483 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49484 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49485 - DNA, 432 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49486 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49487 - DNA, 347 bp, Artificial
  Mutation in BnaC.FAD2.b introduced by TALE nuclease pair BnFAD2_T05
cctctcctccctcaccctctctcctacctcgcctggcctctctactgggcctgccagggctgcgtcctaaccggcctctgggtcatcgcccacgaatgcggccaactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49488 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49489 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 49490 - DNA, 344 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcctctgggtcatagcccacgagtgcgtttgtccactggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacaccaagtggtacggaaagtacctcaacaacccgctaggacgcacggtgatgctaaccgtccagttcacgctcggctggcctttgtacttag

SEQ ID NO: 49491 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtactgag

SEQ ID NO: 49492 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgcccggcgggcctttgtacttag

SEQ ID NO: 49493 - DNA, 353 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49494 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacataaagtggtacggaaagtacctcaacaacccgctaggacgcacggtgatgctaaccgtccagttcacgctcggctggcctttgtacttag

SEQ ID NO: 49495 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49496 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49497 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49498 - DNA, 363 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49499 - DNA, 359 bp, Artificial
  Mutation in BnaC.FAD2.b introduced by TALE nuclease pair BnFAD2_T05
cctctcctccctcaccctcgaaagtacctcgcctggccccgctactgggcctgccaaggcggcgtccaaacgggcacctgggtcagcgcccacgaatgcggaccacgccctcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49500 - DNA, 363 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49501 - DNA, 465 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccatcgccagcaatattggtggcaagcaggcgctggagacggtgccaggcccacggcttgaccccggagcaggtggtggccatcgccagcaatattggtggcaagcaggaaccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49502 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49503 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgccctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtaccccaacaacccgctaggacgcacggtgatgctacccctccagttcacgctcggctggcctttgtacttag

SEQ ID NO: 49504 - DNA, 447 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccattattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49505 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatagcccacgagtgcccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggaagcacggtgaggctaaccgtccagttcacgcccggctggcctttgtacgtag

SEQ ID NO: 49506 - DNA, 283 bp, Artificial
  Mutation in BnaC.FAD2.b introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcacgctcggctggcctttgtacttag

SEQ ID NO: 49507 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49508 - DNA, 435 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49509 - DNA, 344 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtttgtccactggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49510 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49511 - DNA, 333 bp, Artificial
  Mutation in BnaC.FAD2.b introduced by TALE nuclease pair BnFAD2_T05
cctctcctccctcaccctctctcctacttcgcctggcctctctactgggcctgagcaggttattgctggggggtcaccacgccttcagcgactaccagtggctggacgacaccgtctgcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49512 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49513 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcccggctggcctttgtacttag

SEQ ID NO: 49514 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49515 - DNA, 364 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49516 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49517 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctatgacgcacggtgatgctaaccgtccagttcacgctcggctggcctttgtacttag

SEQ ID NO: 49518 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacaccgtcggcctcatcttccactccctcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49519 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49520 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49521 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49522 - DNA, 359 bp, Artificial
  Mutation in BnaC.FAD2.b introduced by TALE nuclease pair BnFAD2_T05
cctctcctccccaccctctcccttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49523 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49524 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgcccccattccaacaccggatccctcgagagggatgaagtgttcgtccccaagaagaaacccgacatcgagtggcacggaaagtacctaagccaccctccgagacgccccgtgatgtaaagggttcagttccctctagcctgccctttgtgactac

SEQ ID NO: 49525 - DNA, 346 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49526 - DNA, 280 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccgaccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49527 - DNA, 355 bp, Artificial
  Mutation in BnaC.FAD2.b introduced by TALE nuclease pair BnFAD2_T05
cctctcctccctcaccctctcccttacctcgcctggcctctctactgggcctgccaagggtgcgtcctaaccggcgtctgggtcatagcccacgagtacaacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49528 - DNA, 358 bp, Artificial
  Mutation in BnaC.FAD2.b introduced by TALE nuclease pair BnFAD2_T05
cctctcctccctcaccctctcccttacctcgcctggcccctctcctgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctgtgtacttag

SEQ ID NO: 49529 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctggatcatcgcccacgaatgcggcccaccacgccttcagcgaccaccagtggctggacgacgccgtgggcctcgtcttccactccttcctcctcgtcccttacttctcctggaagtacagccatcgacgccgccattccaacaccggatccctcgagagggatgaagtgttcgtccccaagaagaaatccgacatcaagtggtacggaaagtacctcaacaaccctttgggacgcaccgtgatgttaacgggtcaggtgactctcggctggcctttgtacttag

SEQ ID NO: 49530 - DNA, 364 bp, Artificial
  Mutation in BnaC.FAD2.b introduced by TALE nuclease pair BnFAD2_T05
cctctcctccctcaccctctctcctacttcgcctggcctatctactgggcctgccaaggctgcgtcctaacgggcctctgggtcatcgcccacgaatgcggcggccaccacgccttcagcgaccaccagtggctggacgactccgtgggcctcgtcttccactccttcctcctcgtcccttacttctcctggaagtacagccatcgacgccaccattccaacaccggatccctcgagagggatgaagtgttcgtccccaagaagaaaaccgacatcgagtggtacggaaagtacctcaacgacccgctaggacgcgcggggaggctaaccgtccagttcacgcccggctggccttggtacgtag

SEQ ID NO: 49531 - DNA, 371 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49532 - DNA, 328 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctgtgtacttag

SEQ ID NO: 49533 - DNA, 392 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaacgaaacccgacaggactataaagataccaggcgtttccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49534 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49535 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctgccattagtacttag

SEQ ID NO: 49536 - DNA, 360 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49537 - DNA, 394 bp, Artificial
  Mutation in BnaC.FAD2.b introduced by TALE nuclease pair BnFAD2_T05
cctctcctccctcaccctctcccttacctcgcctggcccctctcctgggcctgccagggctgcgtcctaaccggcgtctgggtcatagcccacgagcattgctcatcaatttgttgcaacgaacaggtcactatccaccacgccttcagcgactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 49538 - DNA, 358 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccacccttccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49539 - DNA, 435 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctcttggtcattgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49540 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49541 - DNA, 465 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccatcgccagcaatattggtggcaagcaggcgctggagacggtgccaggcccacggcttgaccccggagcaggtggtggccatcgccagcaatattggtggcaagcaggaaccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49542 - DNA, 394 bp, Artificial
  Mutation in BnaC.FAD2.b introduced by TALE nuclease pair BnFAD2_T05
cctctcctccctcaccctctcccttacctcgcctggcccctctactgggcctgcccaggctgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49543 - DNA, 390 bp, Artificial
  Mutation in BnaC.FAD2.b introduced by TALE nuclease pair BnFAD2_T05
cctctcctccctcaccctctcccttacctcgcctgccccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49544 - DNA, 334 bp, Artificial
  Mutation in BnaC.FAD2.b introduced by TALE nuclease pair BnFAD2_T05
cctctcctccctcaccctctcccttacctcgcctggcccatctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcgggtggccgttgtacttagg

SEQ ID NO: 49545 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49546 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctggcctttgtacgtag

SEQ ID NO: 49547 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggatgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgagtctaaccgtccaggtcacgcccggcgggccttggtgcttag

SEQ ID NO: 49548 - DNA, 447 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgctgcttgccaccgccattgctggcgatggccaccacctgctggggggtcaagccgtgggcctggcacagcaccggcaacagccgctggaccaccacgccttcagcgaccaccagtggctggacgacgccgtgggcctcgtcttccactccttccgcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49549 - DNA, 362 bp, Artificial
  Mutation in BnaC.FAD2.b introduced by TALE nuclease pair BnFAD2_T05
cctctcctccctcaccctctcccttacctcgcctgacccctctactgagcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccacgaggacgcaccgtgatgttaacggttcaggtcactctcggctggccttcgtacttag

SEQ ID NO: 49550 - DNA, 358 bp, Artificial
  Mutation in BnaC.FAD2.b introduced by TALE nuclease pair BnFAD2_T05
cctctcctccctcaccctctctcctacttcgcctgccccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtaccgcaacaacccgctaggacgcacggtgatgctaaccgtccagttcacgcgcggctggcctttgtacttag

SEQ ID NO: 49551 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggccacgccttcagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49552 - DNA, 361 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggatagtacctcaacagcccgctaggacgcacggtgatgctaaccggccagttcacgctcggctggcctttgtacttagc

SEQ ID NO: 49553 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49554 - DNA, 333 bp, Artificial
  Mutation in BnaC.FAD2.b introduced by TALE nuclease pair BnFAD2_T05
cctctcctccctcaccctctctcctacttcgcctggcctctctactaggcctgagcaggttattgctggggggtcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49555 - DNA, 358 bp, Artificial
  Mutation in BnaC.FAD2.b introduced by TALE nuclease pair BnFAD2_T05
cctctcctccctcaccctctcccttacctcgtctggcccccttactgggcctgccaaggctgcgccctaacgggcctctgggtcatcgcccacgaatgccaccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcacggtgatgctaaccctccagctcccgctcggctggcctttgtacttag

SEQ ID NO: 49556 - DNA, 350 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtggcttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctagaacgcacggtgatgctaaccgtccaggtcacgctcgcctgccctttgtacttag

SEQ ID NO: 49557 - DNA, 403 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagcaggtggtggccatcgccagcaataatggtggcaagcaggcgctggagaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49558 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 49559 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagtcatctacgccaccattccaacactggctccctcgagagagacgaagtgtttgtccccaagaagaattcagacatcaagtggtacggaaagtacctcaacaacccgctagaacgcacggtgatgctaaccttccagttcacgctcggctggcctttgtacttag

SEQ ID NO: 49560 - DNA, 355 bp, Artificial
  Mutation in BnaC.FAD2.b introduced by TALE nuclease pair BnFAD2_T05
cctctcctccctcaccctctctcctacttcgcctggcctctctcctgggcctgccaagggtgcgtcctcaccggcgtctgggtcatagcccacgagtaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaacggttcagttcactctcggctggcctgtgtacttag

SEQ ID NO: 49561 - DNA, 333 bp, Artificial
  Mutation in BnaC.FAD2.b introduced by TALE nuclease pair BnFAD2_T05
cctctcctccctcaccctctctcctacttcgcctggcctctctactaggcctgagcaggttattgctggggggtcaccacgccttcagcgactcccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49562 - DNA, 332 bp, Artificial
  Mutation in BnaC.FAD2.b introduced by TALE nuclease pair BnFAD2_T05
ccttcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 49563 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgattttaacggttcagttcactctcggctggcctttgtacttag

SEQ ID NO: 49564 - DNA, 283 bp, Artificial
  Mutation in BnaC.FAD2.b introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49565 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49566 - DNA, 357 bp, Artificial
  Mutation in BnaC.FAD2.b introduced by TALE nuclease pair BnFAD2_T05
cctctcctccctcaccctctcacttacctcgcctggcacctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctgggaggaccgccatcgacgccaccattccaacaccggatccctcgagagggatgaagtgttcgtccccaagaagaaagccgccatcaagtggtacggaaagtacctcaacaacccgctagaacgcacggtgatgctatccgtccagttcacgctcggctgccatgtgtacttag

SEQ ID NO: 49567 - DNA, 441 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaagcaggcgctggagacggtccagcggctgttgccggtgctgtgccatggggggtcaagccgtgggcctggcacagcaccggccaccacgccttcagcgaccaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgcccagttcacgctcggctggcctttgtgcttag

SEQ ID NO: 49568 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaagccgctaggacgcacggtgatgctaaccgtccagttcacgctcggctggcctttgtacttag

SEQ ID NO: 49569 - DNA, 362 bp, Artificial
  Mutation in BnaC.FAD2.b introduced by TALE nuclease pair BnFAD2_T05
cctctcctccctcaccctctcgcctacctcttctggcctccctactgggccacccaagggtgcgccctaaccgccggctgggtcatagcccacgagtgcgggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacgtaaagtacctcaacaacccgctaggacgcacggtgatgctaaccgtccagttcacgctcggctggcctttgtacttag

SEQ ID NO: 49570 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccgaggctgcgtcctaacgggcctctgggtcatcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49571 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaagccgacatcaagtggtacggaaagtacctcaacaacccgctaggacgcacggggatgctaaccgtccaggtcacgctcggctggcctttgtacttag

SEQ ID NO: 49572 - DNA, 419 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggtatcttcgagccagccacgatcgacattgatctggcacagcaccggatggtttgactccaccacgccttcagcgaccaccagtggctggacgacgccgcgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49573 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49574 - DNA, 435 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49575 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49576 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgagtgccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 49577 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49578 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccaccacgccttccgcgaccaccagtggctggaccacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49579 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49580 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49581 - DNA, 346 bp, Artificial
  Mutation in BnaC.FAD2.b introduced by TALE nuclease pair BnFAD2_T05
cctctcctccctcaccctatcccttacctcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttctcgctcggctggcctttgtacttag

SEQ ID NO: 49582 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49583 - DNA, 419 bp, Artificial
  Mutation in BnaC.FAD2.b introduced by TALE nuclease pair BnFAD2_T05
cctctcctccctcaccctctaccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49584 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 49585 - DNA, 401 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49586 - DNA, 356 bp, Artificial
  Mutation in BnaC.FAD2.b introduced by TALE nuclease pair BnFAD2_T05
cctctcctccctcaccctatctcctacttcgcctggtctatctactgggcctgccagggctgcgtcctaaccggcgtctgggtcatagcccacgagtgaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 49587 - DNA, 359 bp, Artificial
  Mutation in BnaC.FAD2.b introduced by TALE nuclease pair BnFAD2_T05
cctctcctccctcaccctctcccttacctcgcctggcccctctactcggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactcccggctggcctttgtacttag

SEQ ID NO: 49588 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagggatgaagtgttcgtccccaagaagaaatccgacatcaagtggtacggaaaggacctcagcatcccgcgaggacgagcggtgaagctagccgtgaagttcacgctcgcctggcctttgtacgtag

SEQ ID NO: 49589 - DNA, 333 bp, Artificial
  Mutation in BnaC.FAD2.b introduced by TALE nuclease pair BnFAD2_T05
cctctcctccctcaccctctccattacctcgcctggcccctctactgggcctgccaaggctgcgtcctaaccagcctctgggtcatcgcccacgaatgtggctggacgacgccgtgggcctcgtcttccactccttcctcctcgtcccttacttctcctggaagtacagccatcgacgccaccattccaacagcggatccctcgagagggatgaagtgttcgtccccaagaagaaatccgacatcaagtggtacggaaagtacctcaacaaccctcgaggacgcagggtgatgctaaccgtccagtgcacgcccggctggcctttgtacttag

SEQ ID NO: 49590 - DNA, 430 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgcggatggcctttttgcgtttctacaaactcttcctggctagcggtacgcgtattaattgcgttgcgctcgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49591 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgaatgcggggcccccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49592 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttatacttag

SEQ ID NO: 49593 - DNA, 401 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49594 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49595 - DNA, 432 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcgtctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacgtctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49596 - DNA, 358 bp, Artificial
  Mutation in BnaC.FAD2.b introduced by TALE nuclease pair BnFAD2_T05
cctctctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49597 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49598 - DNA, 356 bp, Artificial
  Mutation in BnaC.FAD2.b introduced by TALE nuclease pair BnFAD2_T05
ccctcctccctcaccctctcccttacctcgcctggcccatctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49599 - DNA, 359 bp, Artificial
  Mutation in BnaC.FAD2.b introduced by TALE nuclease pair BnFAD2_T05
cctctcctccctcaccctatccattacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49600 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49601 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgcccacgaatgcccaccacgccttcagcgaccaccagtggctggatgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49602 - DNA, 357 bp, Artificial
  Mutation in BnaC.FAD2.b introduced by TALE nuclease pair BnFAD2_T05
cctctcctccctcaccctctcccttacctcgcctggcctctctactgggcctgccaagggtgcgtcctaaccggcgtctgggtcatagcccacgagtgccaccacgccttcagcgaccaccagtggctggacaacgctgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaggacgcagcgggatgttaacggttcagttcactctcggctggcctttgtacttag

SEQ ID NO: 49603 - DNA, 333 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49604 - DNA, 443 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49605 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccatcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49606 - DNA, 319 bp, Artificial
  Mutation in BnaC.FAD2.b introduced by TALE nuclease pair BnFAD2_T05
cctctcctccctcaccctctctactacttcgcctggcctctctactgggcctgccaagggtgcgtcctaaccggcgtctgggtcatagcccacgagtgcgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49607 - DNA, 333 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcccaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49608 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacaccgtcggcctcgtcttccactccttcctcctcgtcccttacttctcctggaagtacagtcatcgacgccaccattccaacaccggatccctcgagagggacgaagtgttcgtccccaagaagaaatccgacatcaagtggtacggaatgtacctcaacaacccgctaggacgcacggtgatgctaaccgtccagttcacgctcggctggcctttgtacttag

SEQ ID NO: 49609 - DNA, 360 bp, Artificial
  Mutation in BnaC.FAD2.b introduced by TALE nuclease pair BnFAD2_T05
cctctcctccctcaccctctcccttacctcgcctggcccctctactgagcctgccaaggctgcgttctaacgggcctctgggtcatcgcccacgaatgcggcgccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49610 - DNA, 419 bp, Artificial
  Mutation in BnaC.FAD2.b introduced by TALE nuclease pair BnFAD2_T05
cctctcctccctcaccctctccattacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49611 - DNA, 358 bp, Artificial
  Mutation in BnaC.FAD2.b introduced by TALE nuclease pair BnFAD2_T05
cctctcctccctcaccctctctactacttcgcctggcctctctactgggcctgccagggatgcgtcctaaccggcgtctgggtcatagcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49612 - DNA, 401 bp, Artificial
  Mutation in BnaC.FAD2.b introduced by TALE nuclease pair BnFAD2_T05
cctctcctccctcaccctgtcctttacctcgcctggcccctctactcggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgattgtaacggttcagttcactctcggctggcctttgtacttag

SEQ ID NO: 49613 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgtgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49614 - DNA, 398 bp, Artificial
  Mutation in BnaC.FAD2.b introduced by TALE nuclease pair BnFAD2_T05
cctctcctccctcaccctctctcctacttctcctaccctctctactgtgcctgccatggctgcgtcctaacgagcctctgggtcatcgcccacgaatgcggcggtaaaacagttatccacagaatcaggggataacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgccatcaagtggtccggaaagtaccccaacaacccggaagtgcgcaaggtgaagctaaccgtcccgttcacgctcggctggcctttgtacttag

SEQ ID NO: 49615 - DNA, 447 bp, Artificial
  Mutation in BnaC.FAD2.b introduced by TALE nuclease pair BnFAD2_T05
cctctcctccctcaccctctcccttacctcgcctgccccctctactgggcctgccaaggctgcgtcctaacgggcctctgggtcatcgcccacgaatgctgcttgccaccattattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49616 - DNA, 447 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccattattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 49617 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacacccctttgggacgcaccgtgatgtaaacggttcagttcactcgcggctggccgttgtacgtag

SEQ ID NO: 49618 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49619 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttttacttag

SEQ ID NO: 49620 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49621 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49622 - DNA, 358 bp, Artificial
  Mutation in BnaC.FAD2.b introduced by TALE nuclease pair BnFAD2_T05
cctctcctccctcaccctctctcctacttcgcctggcctatctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctagggcgcacggggatgctaaccgtccagttcacgcacggcgggcctttgtacttag

SEQ ID NO: 49623 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49624 - DNA, 360 bp, Artificial
  Mutation in BnaC.FAD2.b introduced by TALE nuclease pair BnFAD2_T05
cctctcctccctcaccctctctcctacttcgcctggcctctctactcggcctgccagggctgcgtcctaaccggcgtctgggtcatagcccacgagtgtgccacctcgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtactgag

SEQ ID NO: 49625 - DNA, 353 bp, Artificial
  Mutation in BnaC.FAD2.b introduced by TALE nuclease pair BnFAD2_T05
cctctcctccctcaccctctcccttacctcgcctcacccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49626 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49627 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49628 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49629 - DNA, 419 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcggtacgcgtattaattgcgttgcgctcactgcccgcaaaaggccagcaaaaggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49630 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49631 - DNA, 345 bp, Artificial
  Mutation in BnaC.FAD2.b introduced by TALE nuclease pair BnFAD2_T05
cctctcctccctcaccctctaccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49632 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggccccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49633 - DNA, 471 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcttggcgatggcaagcaggcgctggagacggtccagcggctgttgccggtgctgtgccaggcccacggcttgaccccccagcaggtggtggccatcgccagcaataatggtggcaagcaggcgccaccacgccttcagcgactaccagtggctggacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49634 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49635 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcacggctggcctttgtacttag

SEQ ID NO: 49636 - DNA, 346 bp, Artificial
  Mutation in BnaC.FAD2.b introduced by TALE nuclease pair BnFAD2_T05
cctctcctccctcaccctctctactacttcgcttggcctctctactgggcctgccaagggtgcgtcctaaccggcgtctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49637 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49638 - DNA, 435 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49639 - DNA, 358 bp, Artificial
  Mutation in BnaC.FAD2.b introduced by TALE nuclease pair BnFAD2_T05
cctctcctccctcaccctctctactacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcagcaacccgctaggacgcacggtgatgcttagcgtccggttcacgctcggctggcctctgtacttag

SEQ ID NO: 49640 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49641 - DNA, 383 bp, Artificial
  Mutation in BnaC.FAD2.b introduced by TALE nuclease pair BnFAD2_T05
cctctcctccctcaccctctcacctacttcgcctggcctctctactgggcctgccaagggtgcgtcctaaccggcgtctgggtcatagcccacgagtgcggccaccagcggctgttgccggtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtacccaagaagaaatcccacatcgagtggtacggaaagtatctccacaacccgctaggacgcacagtgatgctactctccccggtcacgctcggctggcctgtgtacttag

SEQ ID NO: 49642 - DNA, 329 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggacgacaccgtcggcctcatcttccactccttcctcatcgtcccttacttctcctggaagtacagtcatcgacgccaccattccaacaccggatccctcgagagggatgaagtgttcgtccccaagaagaaatccgacatcaagtggtacggaaagtacctcgacaacccgctaggacgcacggtgatgctaaccgtccagttcacgctcggctggcctttgtacttag

SEQ ID NO: 49643 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggatgcacggtgatgctaaccgtccagttcacgctcggctggcctttgtacttag

SEQ ID NO: 49644 - DNA, 362 bp, Artificial
  Mutation in BnaC.FAD2.b introduced by TALE nuclease pair BnFAD2_T05
cctctcctccctcaccctctctcctacttcgcctggccactctactgggcctgccaagggtgcgtcctaaccggcgtctgggtcatagcccacgagtgcgggccaccacgacttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49645 - DNA, 443 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcctcaagccgtgggcctggtccagcggctgttgccaccgccattgctggcgatggccaccacctgctggggggtcaagccgtgtgccaccacgccttcagcgactaccagtggcctgacgacaccgtcggtctcatcttccactccttcctcctcgtcccttgcttctcctggaagtacagccatcgacgccaccattccaacaccggatccctcgagagggatgaagtgttcgtccccaagaagaaatccgacatcaagtggtacggaaagtacctcaacaacccgctagaacgcacggtgatgctaaccgtccagttcacgctcggctggcatttgtacttag

SEQ ID NO: 49646 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 49647 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49648 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccaccccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 49649 - DNA, 358 bp, Artificial
  Mutation in BnaC.FAD2.b introduced by TALE nuclease pair BnFAD2_T05
cctctcctccctcaccctctctcctacttcgcctggcctctctactggccctgccagggctccgtcctaaccggcgtctgggtcatagcccacgagtgccaccacgccttcagcgaccaccagtggctggacgacgccgccggcctcgtcttccactccttcctcctcgtcccgtacttctcctggaagtacagccatcgacgccaccattccaacaccggatccctcgagagggatgaagtgttcgtccccaagaagaaatccgacatcaagtcgtacggaaagtacctcagcaacccgctaggacgcacggtgatgctaaccgtccagttcacgctcggctggccttagtacttag

SEQ ID NO: 49650 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49651 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcggaccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 49652 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtcccaaagaagaaatccgacatcaagtggtacggaaagtacctcaacaacccgctaggacgcacggtgatgctaaccgtccagttcacgctcggctggcctttgtacttag

SEQ ID NO: 49653 - DNA, 358 bp, Artificial
  Mutation in BnaC.FAD2.b introduced by TALE nuclease pair BnFAD2_T05
cctctcctccctcaccctctcccttacctcgcctcgcccctctactgggcctgccaaggctgcgtcctaacgtgcctctgggtcttcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49654 - DNA, 398 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggtaatacggttatccacagaatcaggggataacggccaccacgccttcagcgaccaccagttgctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49655 - DNA, 355 bp, Artificial
  Mutation in BnaC.FAD2.b introduced by TALE nuclease pair BnFAD2_T05
cctctcctccctcaccctctcacttacctcgcctggcccctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49656 - DNA, 358 bp, Artificial
  Mutation in BnaC.FAD2.b introduced by TALE nuclease pair BnFAD2_T05
cctctcctccctcaccctctctcctacttcgcctggcacctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctccaggaagtacagccatcgacgccaccattccaacaccggatccctcgagagggatgaagtgttcgtccccaagaagaaatccgacatcaagtggtacggaaagtacctcagcaacccgctaggacgcacggtgaggctaaccgtccggttcacgctcggctggcctgtgtacttag

SEQ ID NO: 49657 - DNA, 363 bp, Artificial
  Mutation in BnaC.FAD2.b introduced by TALE nuclease pair BnFAD2_T05
cctctcctccctcaccctctctcctacttcgcctcgcctctctactgggcctgccagggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgtggtacttag

SEQ ID NO: 49658 - DNA, 358 bp, Artificial
  Mutation in BnaC.FAD2.b introduced by TALE nuclease pair BnFAD2_T05
cctctcctccctcaccctatctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49659 - DNA, 364 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49660 - DNA, 344 bp, Artificial
  Mutation in BnaC.FAD2.b introduced by TALE nuclease pair BnFAD2_T05
cctctcctccctcaccctctctcctacttcgcctggcctctctactggtcctgccaagggtgcgtcctaaccgccgtctgggtcatagcccacgagtgcgtactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggggatgctatccgtccagttcacgctcggctggcctttgtacttag

SEQ ID NO: 49661 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtccgggtcatagcccacgagtgcggcacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49662 - DNA, 350 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49663 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49664 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctagcacgcacggtgatgctaaccgtccagttcacgctcggctggcctttgtacttag

SEQ ID NO: 49665 - DNA, 360 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggccacacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49666 - DNA, 345 bp, Artificial
  Mutation in BnaC.FAD2.b introduced by TALE nuclease pair BnFAD2_T05
cctctcctccctcaccctctcacttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49667 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49668 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtattag

SEQ ID NO: 49669 - DNA, 435 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcattgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49670 - DNA, 383 bp, Artificial
  Mutation in BnaC.FAD2.b introduced by TALE nuclease pair BnFAD2_T05
cctctcctccctcaccctctctcctacttctcctggcctctctactgggcctgccagggctgcgccctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggcacggaaagtaccccaccaccccgctaggacgcaaggtgatgctaaccctcccgttcacgctcggctggcctttgtacttag

SEQ ID NO: 49671 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49672 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49673 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaagacgcacggtgatgctaaccgtccagttcacgctcggctggcctttgtacttag

SEQ ID NO: 49674 - DNA, 394 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgacaaacaacagataaaacgaaaggcccagtcttcccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49675 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49676 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtgcggccacacgccttcagcgaccaccagtggctggacgaccccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactta

SEQ ID NO: 49677 - DNA, 350 bp, Artificial
  Mutation in BnaC.FAD2.b introduced by TALE nuclease pair BnFAD2_T05
cctctcctccctcaccctctcggctggcctctctactgggcctgccaagggtgcgtcctaaccggcgtctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 49678 - DNA, 432 bp, Artificial
  Mutation in BnaC.FAD2.b introduced by TALE nuclease pair BnFAD2_T05
cctctcctccctcaccctctctcctacttcgcctggcctctctacagggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49679 - DNA, 364 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 49680 - DNA, 355 bp, Artificial
  Mutation in BnaC.FAD2.b introduced by TALE nuclease pair BnFAD2_T05
cctctcctccctcaccctctcccttacctcgcctggccaccctactcggcctgacaaggctgcgtcctaacgggacgctgggtcatcgcacacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacgtcaattacctcaacaacccgctagtgcgcacggtgatgctaaccctcccgttcccgctcggctggcctttgtacttag

SEQ ID NO: 49681 - DNA, 332 bp, Artificial
  Mutation in BnaC.FAD2.b introduced by TALE nuclease pair BnFAD2_T05
cctctcctcctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49682 - DNA, 344 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49683 - DNA, 350 bp, Artificial
  Mutation in BnaC.FAD2.b introduced by TALE nuclease pair BnFAD2_T05
cctctcctccctcaccctctctcctacttcgcctggcatctctactgggcctgccagggctgcgtcctaaccggcgtctgggtcatagcccaaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgctcggtgatgctaaccgtccagttcacgctcggctggccgttgtacttag

SEQ ID NO: 49684 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49685 - DNA, 443 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49686 - DNA, 463 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgctgcgttaagccaacacccggcagcgttagggaccgtcgctgtcaagtatcaggacattttttctgcgcgtaatctgctgcttgcaaacaaaaaaaccaccgctggaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49687 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49688 - DNA, 333 bp, Artificial
  Mutation in BnaC.FAD2.b introduced by TALE nuclease pair BnFAD2_T05
cctctcctccctcaccctctctcctacttcgcctggcctctctactgggcctgatcaggttattgctggggggtcaccacgccttcagcgactaccagtggctggacgacaccgtctgcctcatcttccactccttcctcctcgtcccttacttctcctggaagtacagtcatcgacgccaccattccaacaccggatccctcgagagggatgatgtgttcgtccccaagaagaaatccgacatcaagtggtacggaaagtacctcaacaacccgctaggacgcacggtgatgctcaccgtccagttcacgctcggctggcctttgtacttag

SEQ ID NO: 49689 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49690 - DNA, 346 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacaggcgtctgggtcatagcccacgagttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49691 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49692 - DNA, 357 bp, Artificial
  Mutation in BnaC.FAD2.b introduced by TALE nuclease pair BnFAD2_T05
cctctcctccctcaccctctcccttacctctcctggcccctctactgtgcctgacagggctgcgccctaaccggcgtctgggtcatagcccacgagtgcaccacgccttcagcgactaccagtggctggacgacaccgtcggcctcatcttccactccttcctcctcgtcccttgcttctcctggaagtacagtcatcgacgccaccattccaacactggctccctcgagagggatgaagtgttcgtccccaagaagaaatccgacatcaagtggtacggaaagtacctcaacaacccgcaaggacgcacggtgatgctaaccgtccagttcactctctgctggcctttgtacttag

SEQ ID NO: 49693 - DNA, 357 bp, Artificial
  Mutation in BnaC.FAD2.b introduced by TALE nuclease pair BnFAD2_T05
cctctcctccctcaccctctcacttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctataacgcacggtgatgctaaccgtccagttcacgctcggctggcctttgtacttag

SEQ ID NO: 49694 - DNA, 360 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggctggacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49695 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcgtctgggtcatagcccacgagtgcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49696 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagctcacgctcggctggcctttgtacttag

SEQ ID NO: 49697 - DNA, 358 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtcttag

SEQ ID NO: 49698 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgagtgcggtaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49699 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtaaataaaaaaaaatttgggaagaaccgtgatgttaacggttcagttcactctaggatggaatttgtacttag

SEQ ID NO: 49700 - DNA, 447 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccgccattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49701 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtgcgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49702 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccctttgtacttag

SEQ ID NO: 49703 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtcaccaagaagaaatccgacatcaagtggtacggaaagtacctcaacaacccgctaggacgcacggtgatgctaaccgtccagttcacgctcggctggcctttgtacttag

SEQ ID NO: 49704 - DNA, 348 bp, Artificial
  Mutation in BnaC.FAD2.b introduced by TALE nuclease pair BnFAD2_T05
cccctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49705 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatctaccacgccttcagcgaccaccagtggctggacgacgccgtgggcctcgtcctccactccttcctcctcgtcccttacttctcctggacgtacagccatcgacgccaccattccaacaccggatccctcgagagggatgaagtgttcgtccccaagaagaaatccgacatcaagtggtacggaaagtacctcagcaacccgctaggacgcacggtgatgctaaccgtccagttcacgctcggctggcctttgtacttag

SEQ ID NO: 49706 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49707 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49708 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 49709 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtccttag

SEQ ID NO: 49710 - DNA, 353 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacgtag

SEQ ID NO: 49711 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49712 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49713 - DNA, 357 bp, Artificial
  Mutation in BnaC.FAD2.b introduced by TALE nuclease pair BnFAD2_T05
cctctcctccctcaccctctctcctacttcgcctggcctctctactgagcctgccagggctgcgtcctaaccggcgtctgggtcatagcccacgagtgcaccacgccttcagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49714 - DNA, 401 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtgcagttcacgctcggctgccctttgtacttag

SEQ ID NO: 49715 - DNA, 348 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 49716 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaaccggcgtctgggtcatagcccacgagtgcgcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49717 - DNA, 358 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcacacgaatgccaccacgccttcagcgaccaccagtggctggacgacgccgtgggcctcgtcttccactccttcctcctcgtcccttacttctcctggaagtacagccatcgacgccaccattccaacaccggatccctcgtgagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49718 - DNA, 390 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcgtcttccactccttactcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49719 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgccgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccggctaggacgcgcggtgatgctaaccttccagttcacgctcggctggccttggtacttag

SEQ ID NO: 49720 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaaccggcgtctgggtcatagcccacgagtgcgtgcgaccacgccttcagtgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49721 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaaccgtccagttcacgctcggctggcctttgtacttag

SEQ ID NO: 49722 - DNA, 447 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccgccattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttactgctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49723 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccctttgtacttag

SEQ ID NO: 49724 - DNA, 333 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49725 - DNA, 352 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49726 - DNA, 356 bp, Artificial
  Mutation in BnaC.FAD2.b introduced by TALE nuclease pair BnFAD2_T05
cctctcctccctcaccctctatcctacttcgcctggcctctctaatgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 49727 - DNA, 333 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49728 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtgccccgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49729 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaaccgtccagttcacgctcggctggcctttgtacttag

SEQ ID NO: 49730 - DNA, 435 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49731 - DNA, 355 bp, Artificial
  Mutation in BnaC.FAD2.b introduced by TALE nuclease pair BnFAD2_T05
cctctcctccctcaccctctctcctacttcgcctggcctctcgactgggcctgccaagggggcgtcctaaccggcgtctgggtcatagcccacgagtaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtccggaaagtacctcaacaccccggtaggacgcacggtgctgccacccgtcccgttcccgctcggctggcctttgtacttag

SEQ ID NO: 49732 - DNA, 363 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49733 - DNA, 346 bp, Artificial
  Mutation in BnaC.FAD2.b introduced by TALE nuclease pair BnFAD2_T05
cctctcctccctcaccctctcccttacctcgcctgccccctctactgtgcctgccaactctgcgtccaaacgggcctctgggtcatcgcccacgccttcatcgaccaccagtggctggacgacgccgtgggcctcgtcttccactccttcctcctcgtcccttacttctcctggaagtacagccatcgacgccaccattccaacaccggatccctcgagagagatgaagtgttcgtccccaagaagaaatccggcatcaagtggtacggaaagtagtccgacacgccatatggatgcaccgggctgccaccggtccagttccctctcggctggcctttgtacttag

SEQ ID NO: 49734 - DNA, 410 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatattggtggcaagcaggcgctggagacggtgcaggcgctgttgccggtgctgtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49735 - DNA, 364 bp, Artificial
  Mutation in BnaC.FAD2.b introduced by TALE nuclease pair BnFAD2_T05
cctctcctccctcaccctctcccttacctcgcgtgccccccttactgagcctgccaaggctgcgtcctaccggccctctgggtcatcgcccacgaatgcgtcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacgacccattgggatgcacagtaatgttaacggttcagttcactctcggctggcctttgtacttag

SEQ ID NO: 49736 - DNA, 355 bp, Artificial
  Mutation in BnaC.FAD2.b introduced by TALE nuclease pair BnFAD2_T05
cctctcctccctcaccctctctcctacttcgcctggcctctctactggtcctgacatcgctgcgccctcaccaccgtctgggtcctagcacacgagtaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaacccgacatcaagtggtacggaaagtagccgaacacgccggaagggtgcacggtgatgctaatcgtccagttcacgctcggctggcctttgtacttag

SEQ ID NO: 49737 - DNA, 362 bp, Artificial
  Mutation in BnaC.FAD2.b introduced by TALE nuclease pair BnFAD2_T05
cctctcctcctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49738 - DNA, 398 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgtcgggtttcggcaggtggtggccatcgccagcaatggcggtgaccacgccttcagcgactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49739 - DNA, 401 bp, Artificial
  Mutation in BnaC.FAD2.b introduced by TALE nuclease pair BnFAD2_T05
cctctcctccctcaccctctcccttacctcgcctggcccctttactgggcctgccaaggctgcgtcctaacgggcctctgggtcatcgcccacgaatgcggctgttgccggagctgtgccaggcccacggcttgaccccggacaccacgccttcagcgaccaccagtggctggaccacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctagtgcacacggtaatgctaaccgtccagttcacgctcggctggcctttgtacttag

SEQ ID NO: 49740 - DNA, 348 bp, Artificial
  Mutation in BnaC.FAD2.b introduced by TALE nuclease pair BnFAD2_T05
cctctcctccctcaccctctcccttacctcgcctggcctctctactgggcctgccagggctgcgtcctaaccggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49741 - DNA, 362 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgcggcccaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49742 - DNA, 362 bp, Artificial
  Mutation in BnaC.FAD2.b introduced by TALE nuclease pair BnFAD2_T05
ccctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49743 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 49744 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacaggcctctgggtcatcgcccacgaatgtggctggacgacgccgtgggcctcgtcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49745 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgtgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49746 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49747 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49748 - DNA, 358 bp, Artificial
  Mutation in BnaC.FAD2.b introduced by TALE nuclease pair BnFAD2_T05
cctctcctccctcaccctctcccttacctctcctggcccctctactcggcctgccaaggctgcgccctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaaaccgacatcaagtggtacggaaagtaccccaacacgcctgtgggacgcaacaggaggctaacggtgccgttccctctcggctggcctttgtacttag

SEQ ID NO: 49749 - DNA, 396 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtggtggccatcgccagcaatggcggtggcaagcaggcgctggaccacgccttcagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49750 - DNA, 349 bp, Artificial
  Mutation in BnaC.FAD2.b introduced by TALE nuclease pair BnFAD2_T05
cctctcctccctcaccctctctcctacttcgcctggcctctctactgggcctgcaaagggtgcgtcctaaccggcgtctgggtcatagcccaccacgctttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49751 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49752 - DNA, 443 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 49753 - DNA, 394 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49754 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49755 - DNA, 346 bp, Artificial
  Mutation in BnaC.FAD2.b introduced by TALE nuclease pair BnFAD2_T05
cctctcctccctcaccctctcccttacctcgcctggcccctctcctgggcctgccaaggctgcgtcctaacgggcctctgggtcatcgcccacgccttcagcgaccaccagtggctggacgacgcggtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 49756 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49757 - DNA, 346 bp, Artificial
  Mutation in BnaC.FAD2.b introduced by TALE nuclease pair BnFAD2_T05
cctctcctccctcaccctctcccttacctcgcctggcctctctactgggcctgccaagggtgcgtcctaaccggcgtctgggtcatagcccacgagttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49758 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtgcggccacacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 49759 - DNA, 329 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49760 - DNA, 395 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtggtggccatcgccagcaatggcggtggcaacagccgctggaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49761 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49762 - DNA, 350 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggccagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49763 - DNA, 280 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49764 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagctactaccagtgtctggacgacaccgtctgcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtaagtctaaccgtcaagttcacgcccggctggcctttgtacttag

SEQ ID NO: 49765 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49766 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49767 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcactctcggctggcctttgtacttag

SEQ ID NO: 49768 - DNA, 354 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactag

SEQ ID NO: 49769 - DNA, 390 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49770 - DNA, 396 bp, Artificial
  Mutation in BnaC.FAD2.b introduced by TALE nuclease pair BnFAD2_T05
cctctcctccctcaccctctctcctacttcgcctggcctctctactgggccatcgccagcaataatggtggcaagcaggcgctggagacggtccagcggctgttgccggtgctgtgccaggcccacggcttgacccccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49771 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcaattgtacttag

SEQ ID NO: 49772 - DNA, 432 bp, Artificial
  Mutation in BnaC.FAD2.b introduced by TALE nuclease pair BnFAD2_T05
cctctcctccctcacactctctcctacttcgcctggcctctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgaccccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49773 - DNA, 425 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgagtgcggccaccgccattgctggcgatgagcgttcaccgacaaacaacagataaaacgaaaggcccagtcttaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacacacggtgatgctaaccgtccagttcacgctcggctggcctttgtacttag

SEQ ID NO: 49774 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtccttag

SEQ ID NO: 49775 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49776 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49777 - DNA, 331 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcagcgactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 49778 - DNA, 401 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49779 - DNA, 360 bp, Artificial
  Mutation in BnaC.FAD2.b introduced by TALE nuclease pair BnFAD2_T05
cctctcctccctcaccctctctactacttcgcctggcctctctactgggcctgccagggctgcgtcctaaccggcgtctgggtcatagcccacgagtgcggccacccgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49780 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctatgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49781 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49782 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaagggcgcgtcctaaccggcgtctgggtcatagcccacgagtaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49783 - DNA, 358 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49784 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacccaacaacccgctaggacgcacggtgatgctaaccgtccagttcacgctcggctggcctttgtacttag

SEQ ID NO: 49785 - DNA, 356 bp, Artificial
  Mutation in BnaC.FAD2.b introduced by TALE nuclease pair BnFAD2_T05
cctctcctccctcaccctctctcctacttcgcctggcctctctactgggcctgctagggctgcgtcctaaccggcgtctgggtcatagcccacgagtgaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49786 - DNA, 356 bp, Artificial
  Mutation in BnaC.FAD2.b introduced by TALE nuclease pair BnFAD2_T05
cctctcctccctcaccctctctactacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49787 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49788 - DNA, 395 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtggtggccatcgccagcaatggcggtggcaacagccgctgggccacgccttcagcgactaccagtggcttgacgacaccgtcggtctcatcttccactccttcctcctcgtcccttacttctcctggaagtacagccatcgacgccaccattccaacaccggatccctcgagagggatgaagcgttcgtccccaagaagaaatccgacatcaagtggtacggaaagtacctcaacaacccgctaggacgcacggtgatgctaaccgtccagttcacgctcggctggcctttgtacttag

SEQ ID NO: 49789 - DNA, 358 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49790 - DNA, 452 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggttgccggtgctgtgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttccttctcctggaagtacagccatcgacgccaccattccaacaccggatccctcgagagggatgaagtgttcgtccccaagaagaaatccgacgtcaagtggtacggaaagtacctcaacaacccgctaggacgcgcggtgaggggaaccgtccagggcacgctcggctggccgttggacggag

SEQ ID NO: 49791 - DNA, 351 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacgccccgctaggacgcacggtgatgctaaccgtcccgttcccgctcggctggcctttgtacttag

SEQ ID NO: 49792 - DNA, 419 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49793 - DNA, 360 bp, Artificial
  Mutation in BnaC.FAD2.b introduced by TALE nuclease pair BnFAD2_T05
cctcttctccctcaccctttctcctacttcgcctggcctctctactgggcctgccaagggtgcgtcctaaccggcgtctgggtcatagcccacgagtgcggccacacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttatacttag

SEQ ID NO: 49794 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49795 - DNA, 410 bp, Artificial
  Mutation in BnaC.FAD2.b introduced by TALE nuclease pair BnFAD2_T05
cctctcctccctcaccctctccattacctcgcctggcccctctactgggcctgtcaaggctgcgtcctaacgggcctctgggtcatcgcccacgaatattggtggcaagcaggcgctggagacggtgcaggcgctgttgccggtgctgtgccaccacgccttcagcgaccaccagaggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49796 - DNA, 441 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaagcaggcgctggagacggtccagcggctgttgccggtgctgtgccatggggggtcaagccgtgggcctggcacagcaccggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49797 - DNA, 346 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49798 - DNA, 323 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtgcggccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcaccctcggctggcctttgtccttag

SEQ ID NO: 49799 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49800 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49801 - DNA, 319 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49802 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49803 - DNA, 358 bp, Artificial
  Mutation in BnaC.FAD2.b introduced by TALE nuclease pair BnFAD2_T05
cctcttctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaactggtacggaaagtacctcaacaacccgctaggacgcccggtgatgctaaccgtccagttcacgctcggctggcctttgtacttag

SEQ ID NO: 49804 - DNA, 357 bp, Artificial
  Mutation in BnaC.FAD2.b introduced by TALE nuclease pair BnFAD2_T05
cctctcctcctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49805 - DNA, 358 bp, Artificial
  Mutation in BnaC.FAD2.b introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49806 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaagactgcgtcctaacgggcctctgggtcatcgcccacgaatgccaccacgccttcagcgaccaccagtggctggacgacgccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49807 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 49808 - DNA, 280 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49809 - DNA, 333 bp, Artificial
  Mutation in BnaC.FAD2.b introduced by TALE nuclease pair BnFAD2_T05
cctcttctccctcaccctgtcccttacctcgcctggcccctctactcggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgagggtaacggttcagttcacgctcggctggcctttgtacttag

SEQ ID NO: 49810 - DNA, 358 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49811 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 49812 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49813 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49814 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggctggcctttgtacttag

SEQ ID NO: 49815 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49816 - DNA, 358 bp, Artificial
  Mutation in BnaC.FAD2.b introduced by TALE nuclease pair BnFAD2_T05
cctctcctccctcaccctctcccttacctcgcctggcctctctactgggcctgccagggctgcgtcctaaccggcgtctgggtcatagcccacgagtgtcaccacgccttcagcgactaccagtggctggacgacaccgtcggcctcatcttccactccttcctcctcgtccattacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49817 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49818 - DNA, 449 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgttcttcatgaaggtgtacggctacaggggcaagcacctgggcggctccaggaatcccgacggcgccatctacaccgtgggctcccccatccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49819 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctgccctttgtacgtag

SEQ ID NO: 49820 - DNA, 359 bp, Artificial
  Mutation in BnaC.FAD2.b introduced by TALE nuclease pair BnFAD2_T05
cctctcctccctcaccctctctactacttcgcctggcctctctactgagcctgccaagggtgcgtactaaccggcgtctgggtcatagcccacgagtgcgcaccacgacttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatcccacatcaagtggtacggaaagttcctcaacaacccgctaggacgcacggtgatgctaaccgtccagttcacgctcggctggcctttgtacttag

SEQ ID NO: 49821 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaaccggcgtctgggtcatagcccacgagtcggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49822 - DNA, 280 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49823 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcccgctcggctggcctttgtccttag

SEQ ID NO: 49824 - DNA, 424 bp, Artificial
  Mutation in BnaC.FAD2.b introduced by TALE nuclease pair BnFAD2_T05
cctctcctccctcaccctctctcctacttcgcctggcctctctactgggcctgccacggctgcgtcctcaccggcgtctgggtcatagccaacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagtcatcgacgccaccattccaacaccggatcccgcgagagggatgaagtgttcgtccccaagaagaaatccgacatcaagtggtacggaaagtacctcaacatcccgcgaggacgcgcggtgatgctagccgcccatttcacgctcggccggcatttgtacgtag

SEQ ID NO: 49825 - DNA, 360 bp, Artificial
  Mutation in BnaC.FAD2.b introduced by TALE nuclease pair BnFAD2_T05
cctctcctccctcaccctctctactacttcgcctggcctctctactgggcctgccaagggtgcgtcctaaccggcgtctgggtcatagcccacgagtgcggcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49826 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagtgctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49827 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgtgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49828 - DNA, 358 bp, Artificial
  Mutation in BnaC.FAD2.b introduced by TALE nuclease pair BnFAD2_T05
cctctcttccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49829 - DNA, 358 bp, Artificial
  Mutation in BnaC.FAD2.b introduced by TALE nuclease pair BnFAD2_T05
cctctcctccctcaccctctcccctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49830 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49831 - DNA, 348 bp, Artificial
  Mutation in BnaC.FAD2.b introduced by TALE nuclease pair BnFAD2_T05
cctctcctccctcaccccctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49832 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccaccagtggccggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggaaagtacctcaacaaccctctaggacgcacggtgaggctaaccgtccagttcacgctcggctggcctttgtacttag

SEQ ID NO: 49833 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49834 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctcttggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49835 - DNA, 345 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49836 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49837 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 49838 - DNA, 356 bp, Artificial
  Mutation in BnaC.FAD2.b introduced by TALE nuclease pair BnFAD2_T05
cctctcctccctcaccctctctcctacttcgtctggcctctctactgggcctgacagggctgcgtcctaaccggcgtctgggtcatagcccacgagtgaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaacccgacatcaagtggtccggaaagtacctcaacaacccggtagggcgtacggggctgctaaccgtccagctcacgctcggctggcctttgtacttag

SEQ ID NO: 49839 - DNA, 359 bp, Artificial
  Mutation in BnaC.FAD2.b introduced by TALE nuclease pair BnFAD2_T05
cctctcctccctcaccctctcccttacctcgcctggcccctctactgggcctcccaaggctgcgtcctaacgggcctctgggtcatcgcccacgaatgtccaccacgccttcagcgaccaccagtggctggacgactccgtgggcctcgtcttccactccttcctcctcgtcccttacttctcctggaaggacagccatcgacgccaccattccaacaccggatccctcgagagggatgaagtgttcgtccccaagaagaaatccgacatcaagtggtacggaaagtacctcaacaacccgctaggacgcacggtgatactaaccgtccagttcacgctcggctggcctttgtacttag

SEQ ID NO: 49840 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacgccgtgggcctcgtcctccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49841 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49842 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctcacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccatccagttcacgctcggctggcctttgtacttag

SEQ ID NO: 49843 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcgtaaccggcgtctgggtcatagcccacgagtgaccacgccttcagcgaccaccagtggctggacgacgccgtgggcctcgtcctccactccttcctcctcgtcccttacttctcctggaagtacagccatcgacgccaccattccaacaccggatccctcgagagagacgaagtgttcgtccccaagaagaaacccgacatcaagtggtacgggaagtacctcaacaacccgctagaacgcactgtgatgcgaaccggccagttcacgctcggctggcctttgcgcttag

SEQ ID NO: 49844 - DNA, 401 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcctcccttacttctcctggaagtacagccatcgacgccaccattccaacaccggatccctcgcgagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49845 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 49846 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaagactgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49847 - DNA, 348 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagccaccacgccttcagcgactaccagtggctggacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49848 - DNA, 358 bp, Artificial
  Mutation in BnaC.FAD2.b introduced by TALE nuclease pair BnFAD2_T05
cctcttctccctctccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaacccgctaggacgcacggtgaggctaaccgtccagttcacgcgcggctggcctttgtacttag

SEQ ID NO: 49849 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49850 - DNA, 357 bp, Artificial
  Mutation in BnaC.FAD2.b introduced by TALE nuclease pair BnFAD2_T05
cctctcctcctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccgtatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49851 - DNA, 401 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtacaggtcacgctcggctggcctttgtacttag

SEQ ID NO: 49852 - DNA, 398 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggtaatacggttatccacagaatcaggggataacggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49853 - DNA, 323 bp, Artificial
  Mutation in BnaC.FAD2.b introduced by TALE nuclease pair BnFAD2_T05
cctctcctccctcaccctctctcctacttcgcctgccctctctactgggcctgccaagggtgcgtcctaaccggcgtctgggtcatagcccacgagtgcggccgtcggtctcatcttccactccttcctcctcgtcccttacttctcctggaagtacagccatctacgccaccattccaacaccggatccctcgagagggatgaagtgttcgtccccaagaagaaatccgacatcaagtggtacggaaagtaccgcaacaacccgctaggacgcacggtgatgctaaccgtccatttcacgctcggctggcctgtgtacttag

SEQ ID NO: 49854 - DNA, 435 bp, Artificial
  Mutation in BnaC.FAD2.b introduced by TALE nuclease pair BnFAD2_T05
cctctcctccctcaccctctcccttacctctcctggcccctctactgggcctgccaagtctgcgccctaacggccctctgggtcattgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtccctgacttctcctggaagtacagtcatcgacgccaccattccaacaccggatccctcgagagggatgaagtgttcgtccccaagaagaaatccgacatcaagtggtatggaaagtccctcaacacgccggaaggacgtaaggggctgctacccctcccgttcccgctcggctggcctttgtacttag

SEQ ID NO: 49855 - DNA, 358 bp, Artificial
  Mutation in BnaC.FAD2.b introduced by TALE nuclease pair BnFAD2_T05
cctctcctccctcaccctctaccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49856 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacggccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49857 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49858 - DNA, 346 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49859 - DNA, 353 bp, Artificial
  Mutation in BnaC.FAD2.b introduced by TALE nuclease pair BnFAD2_T05
cctctcctccctcaccctctctcctacttcgcctggcccctctactaggcctgccaaggctgcgtcctaacgtccctctgggtcatcgcccacgcaccacgccttcatcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacaacaagtggtacggaaagtacctcaacaacccgctagaacgcccggtgacgctaaccgtccagttcacgcgcggctggcctgagtacttag

SEQ ID NO: 49860 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49861 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgataaggacgaagtgttcgtccccaagaagaaatccgacatcaagtggtacggcaagtacctcaacaacccgctaggacgcacggtgatgctatccgtccagttcaagctcggctggcctttgtacttag

SEQ ID NO: 49862 - DNA, 349 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49863 - DNA, 402 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggcttcccctggagagagcgagattctccgcgctgtagaagtcacaccacgccttcagcgactaccagtggctggacgacgccgtgggcctcgtcttccactccttcctcctcgtccattacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 49864 - DNA, 465 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccatcgccagcaatattggtggcaagcaggcgctggagacggtgccaggcccacggcttgaccccggagcaggtggtggccatcgccagcaatattggtggcaagcaggaaccttcagcgaccaccagtggctggacgacgccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49865 - DNA, 348 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49866 - DNA, 350 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagccctaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49867 - DNA, 401 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcggctgttgccggtgctgtgccaggcccacggcttgaccccggacaccacgccttcagctaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49868 - DNA, 398 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggtaatacggttatccacagaatcaggggataacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49869 - DNA, 360 bp, Artificial
  Mutation in BnaC.FAD2.b introduced by TALE nuclease pair BnFAD2_T05
cctctcctccctcaccctctcccttacctcgcctggcctctctactgggcctgccaagggtgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49870 - DNA, 435 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcattgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49871 - DNA, 333 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49872 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 49873 - DNA, 371 bp, Artificial
  Mutation in BnaC.FAD2.b introduced by TALE nuclease pair BnFAD2_T05
cctctcctccctcaccctctctcctacttcgcctggcctctctcctgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaacccgacatcaagtggtacggaaagtacctcaacaacccgctaggacgcacggtgattcttaccgtccagttcacgctcggctggcctttgtacctag

SEQ ID NO: 49874 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49875 - DNA, 398 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgggaataaggttatccacagaatcaggggataacggccaccacgccctcagcgaccaccagtggctggaagacgccgtgggcctcgtcttccactccttcctcctcctcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49876 - DNA, 356 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagccaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49877 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgaaaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49878 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49879 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcagggtgatgctaaccgtccagttcacgctcggctggcctttgtacttag

SEQ ID NO: 49880 - DNA, 390 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49881 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtattag

SEQ ID NO: 49882 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49883 - DNA, 362 bp, Artificial
  Mutation in BnaC.FAD2.b introduced by TALE nuclease pair BnFAD2_T05
cctcttctccctcaccctctctcctacttcgcctggcctctctactgggcctgccaagggtgcgtcctaaccggcgtctgggtcatagcccacgagtgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49884 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtcggcctcgtcttccactccttcctcctcgtcccttacttctcctgtaagtacagccatcgacgccaccattccaacacccgatccctcgagagggatgaagtgttcgtccccaagaagaagccagacatcaagtggtacggcaagtacctcaacaaccctttgggccgcaccgtgatgttaacggttcagttccctctcggctggcctttgcacttag

SEQ ID NO: 49885 - DNA, 435 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49886 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 49887 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtggtgttaacggttcagttcactctcggctggcctttgtacttag

SEQ ID NO: 49888 - DNA, 358 bp, Artificial
  Mutation in BnaC.FAD2.b introduced by TALE nuclease pair BnFAD2_T05
cctctcctccctcaccctctcccttacctcgcctcgcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacatcccgctaggacgcacggtgatgctaaccgtccagttcacgcgcggctggccgttgtactgag

SEQ ID NO: 49889 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctcttggtcatcgcccacgaatgcggaccacgccttcagcgaccaccagtggctggacgacgccgtgggcctcgtcttccactccttcctcctcgtcccttacttctcctggaagtaccgccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49890 - DNA, 401 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggctttaccccggacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49891 - DNA, 355 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggcgggccttggtacttag

SEQ ID NO: 49892 - DNA, 350 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagccctaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 49893 - DNA, 333 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49894 - DNA, 360 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcatggtgatgctaaccgtccagttcacgctcggctggcctttgtacttag

SEQ ID NO: 49895 - DNA, 352 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccaccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49896 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49897 - DNA, 363 bp, Artificial
  Mutation in BnaC.FAD2.b introduced by TALE nuclease pair BnFAD2_T05
cctctcctccctcaccctctcccttacctcgcctggcccctctactgcgcctgccaaggccgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49898 - DNA, 370 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactag

SEQ ID NO: 49899 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagcacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49900 - DNA, 358 bp, Artificial
  Mutation in BnaC.FAD2.b introduced by TALE nuclease pair BnFAD2_T05
cctctccgccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49901 - DNA, 394 bp, Artificial
  Mutation in BnaC.FAD2.b introduced by TALE nuclease pair BnFAD2_T05
cctctcctccctcaccctctctactacttcgcctggcctctctactgggcctgccaagggtgcgtcctaaccggcgtctgggtcatagcccacgagcattgctcatcaatttgttgcaacgaacaggtcactatccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49902 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgattgtaacggttcagttcactctcggctggcctttgtacttag

SEQ ID NO: 49903 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtctcttacttctcctggaagtacagccatcgacgccaccattccaacaccggatccctcgagagggatgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 49904 - DNA, 357 bp, Artificial
  Mutation in BnaC.FAD2.b introduced by TALE nuclease pair BnFAD2_T05
cctctcctccctcaccctctcccttacctcgcctggcccctctactgggcccgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49905 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgaaaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49906 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 49907 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgagtgtcaccacgccttcagcgaccaccagtggctggacgacgccgtgggcctcgtcttccactccttcctcctcgtcccttacttctcctggaagtacagccatcgacaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49908 - DNA, 355 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtcaccaagaagaaatccgacatcaagtggtacggaaagtacctcaacaacccgctaggacgcacggtgatgctaaccgtccagttcacgctcggctggcctttgtacttag

SEQ ID NO: 49909 - DNA, 394 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49910 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49911 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcgggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49912 - DNA, 357 bp, Artificial
  Mutation in BnaC.FAD2.b introduced by TALE nuclease pair BnFAD2_T05
ccttcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgcctttgtacttag

SEQ ID NO: 49913 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49914 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49915 - DNA, 358 bp, Artificial
  Mutation in BnaC.FAD2.b introduced by TALE nuclease pair BnFAD2_T05
cctctccttcctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49916 - DNA, 426 bp, Artificial
  Mutation in BnaC.FAD2.b introduced by TALE nuclease pair BnFAD2_T05
cctctcctccctcaccctctcggctggcacctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49917 - DNA, 282 bp, Artificial
  Mutation in BnaC.FAD2.b introduced by TALE nuclease pair BnFAD2_T05
cctctcctcctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttggggcgcaccgtgatgttaacggttcagttcactctcggctggcctttgtacttag

SEQ ID NO: 49918 - DNA, 353 bp, Artificial
  Mutation in BnaC.FAD2.b introduced by TALE nuclease pair BnFAD2_T05
cctctcctccctcaccctctctcctacttcgcctagactctctactgggcctgccaagggtgcgtcctaaccggcgtctgggtcatagcccacgagtgcggccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcgaggacgcgcggtgatcctaaccgtccagttcacgcgtggctggccgttgtacttag

SEQ ID NO: 49919 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 49920 - DNA, 319 bp, Artificial
  Mutation in BnaC.FAD2.b introduced by TALE nuclease pair BnFAD2_T05
cctctcctccctcaccctctctcctacttcgcctggcccctctactgggcctgccagggctgcgtcctaaccggcgtctgggtcatagccctcgagtgcgccggcctcatcttccactccttcctcctcgtcccttacttctcctggaagtacagccatcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctggccgttggacttag

SEQ ID NO: 49921 - DNA, 358 bp, Artificial
  Mutation in BnaC.FAD2.b introduced by TALE nuclease pair BnFAD2_T05
cctctcctccctcaccctatcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactcgcggctggcctttgtacttag

SEQ ID NO: 49922 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 49923 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgtccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctctaggacgcacggtgatgctaaccgtccagttcacgctcggctggcctttgtacttag

SEQ ID NO: 49924 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 49925 - DNA, 329 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49926 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgatgtgttcgtccccaagaagaaatccgacatcaagtggtacggaaagtacctcaacaacccgctaggacgcacggtgatgctaaccgtccagttcacgctcggctggcctttgtacttag

SEQ ID NO: 49927 - DNA, 363 bp, Artificial
  Mutation in BnaC.FAD2.b introduced by TALE nuclease pair BnFAD2_T05
cctctcctccctcaccctctcccttacctcgcctggcctctctactgggcctgccaagggtgcgtcctaaccggcgtctgggtcatagcccacgagtgcggccccaccacgccttcagcgactaccagtggcttgacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 49928 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccactagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49929 - DNA, 465 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccatcgccagcaatattggtggcaagcaggcgctggagacggtgccaggcccacggcttgaccccggagcaggtggtggccatcgccagcaatattggtggcaagcaggaaccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacactcggctggcctttgtacttag

SEQ ID NO: 49930 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaaccggcgtctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49931 - DNA, 359 bp, Artificial
  Mutation in BnaC.FAD2.b introduced by TALE nuclease pair BnFAD2_T05
cctctcctccctcaccctctcccttacctcgcctggcccctctcctgggcctgccaaggctgcgtcctaccgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 49932 - DNA, 364 bp, Artificial
  Mutation in BnaC.FAD2.b introduced by TALE nuclease pair BnFAD2_T05
cctctcctccctcaccctctcccttacctcgcctggcccctctactgagcctgccaaggctgcgtcctaacgggcctctgggtcatcgcccacgaatgcggcgaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacatcccgctaggacgcacggtgatgctaaccgtacagttcacgctcggctggcctttgtacttag

SEQ ID NO: 49933 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49934 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgttag

SEQ ID NO: 49935 - DNA, 354 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggctttgtacttag

SEQ ID NO: 49936 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagccatcgacgccaccattccaacaccgtatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49937 - DNA, 358 bp, Artificial
  Mutation in BnaC.FAD2.b introduced by TALE nuclease pair BnFAD2_T05
cctctcctccctcaccctctcccttacctcgcctggcctctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccacaattccaacaccggatccctcgagagggatgaagtgttcgtccccaagaagaaatccgacatcaagtggtacggaaagtacctcaacaacccgctaggacgcacggtgatgctaaccgtccagttaacgctcggctggcctttgtacttag

SEQ ID NO: 49938 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49939 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49940 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtgcggggccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49941 - DNA, 359 bp, Artificial
  Mutation in BnaC.FAD2.b introduced by TALE nuclease pair BnFAD2_T05
cctctcctccctcaccctctcccttacctcgcctggcaactctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49942 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgcctccagcgaccaccagtggctggacgacgccgtgggcctcgtcttccactccttcctcctcgtcccttacttctcctggaagtacagccatcgacgccaccattccaacaccggatccctcgagagggacgaagtgttcgtccccaagaagaaatccgacatcaagtggtacggaaagtacctcaacaacccgctaggacgcacggtgatgttaacggttcagttcacgctcggctggcctttgtacttag

SEQ ID NO: 49943 - DNA, 356 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaactggcacagcaccggcaacagccgctggacaacgccttcagcgactaccagtggctggacgacaccgtcgtcctcatcttccactccttcctcctcgtcccttacttctcctggaagtacagccatcgacaccaccgttccaacaccggatccctcgagagggatgaagtgttcgtccccaagaagaaaaccaacatcaagtggtaccgaaagtacctcaacaaccctttgggacgcaccgtgaggttaacgtttcagttcactctcggctggcctttgtacttag

SEQ ID NO: 49944 - DNA, 356 bp, Artificial
  Mutation in BnaC.FAD2.b introduced by TALE nuclease pair BnFAD2_T05
cctctctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49945 - DNA, 349 bp, Artificial
  Mutation in BnaC.FAD2.b introduced by TALE nuclease pair BnFAD2_T05
cctctcctccctcaccctctcccttacctcggctggcccctctactgggcctgcaaagggtgcgtcctaaccggcgtctgggtcatagcccaccacgctttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49946 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacggcgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49947 - DNA, 447 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccattattgctggcgatggccaccacctgctggggggtcaagccgtgggcctggcacagcaccggcaacagccgctggaccaccacgccttcagcgaccaccagtggctggacgacgccgtggccctcgtcttccactccttcctcctcgtcccttacctcgcctggaagtacagccatcgacgccaccattccaacaccggatacctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49948 - DNA, 357 bp, Artificial
  Mutation in BnaC.FAD2.b introduced by TALE nuclease pair BnFAD2_T05
cctctccttcctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagaggtatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49949 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49950 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49951 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggctccctcgagagggacgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 49952 - DNA, 443 bp, Artificial
  Mutation in BnaC.FAD2.b introduced by TALE nuclease pair BnFAD2_T05
cctctcctccctcaccctatcccttacctcgcctggcccctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49953 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtgctacggaaagtacctcaacaacccgctaggacgcacggtgatgctaaccgtccagttcaccctcggctggcctttgtacttag

SEQ ID NO: 49954 - DNA, 398 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggtaatacggttatccacagaatcaggggataacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagtgcacgctcggcgggccgttgtacttag

SEQ ID NO: 49955 - DNA, 401 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccttcagcgaccaccagtggctggacgacgccgtgggcctcgtcttccactccttcctcctcggcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49956 - DNA, 358 bp, Artificial
  Mutation in BnaC.FAD2.b introduced by TALE nuclease pair BnFAD2_T05
cctctcctccctcaccctatcacttacctcgcctggcccctctactgggcctgccaaggctgcgtcctaacgggcctctgggtcatcgccaacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttgtacttag

SEQ ID NO: 49957 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgagtgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49958 - DNA, 283 bp, Artificial
  Mutation in BnaC.FAD2.b introduced by TALE nuclease pair BnFAD2_T05
cctctcctccctcaccctatcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtacccaagaagaaatccgacatcaagtggtacggaaagtacctcaacaacccgctaggacgcacggtgatgctaaccgtccagttcacgctcggctggcctttgtacttag

SEQ ID NO: 49959 - DNA, 355 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49960 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 49961 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccaccacgccttcagcgaccaccagtggatggacgacgccgtgagcctcgccttccactccttcctcctcgtcccttacttctcctggaagtacagccatcgacgcccccattccaacaccggatccctcgagagggatgaagtgtccgtccccaagaagaaatccgacatcaagtggtacggaaagtacctcaacaacccgccaggacgcgcggtggtgctaaccgtccagtgcgcgctcggctggcctttgtccttag

SEQ ID NO: 49962 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgtccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49963 - DNA, 359 bp, Artificial
  Mutation in BnaC.FAD2.b introduced by TALE nuclease pair BnFAD2_T05
cctctcctccctcaccctctcccttacctcgcctcgcaactctaatgggcctgccaaggctgcgtcctaacgggcctctgggtcatcgcccacgaatgcgcaccacgccttcagcgaccaccagtggctggacgacgccgtgggcctcgtcttccaccccttcctcctcgtcccttacttctcctggaagtacagccatcgacgccaccattcccacaccggatccctcgagagggatgaagtgttcgtccccaagaagaaatccgacatcaagtggtacggaaagtacctcaacaacccgctaggacgcacggtgatgctaaccgtccatttcacgctcggctggcctttgtacttag

SEQ ID NO: 49964 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 49965 - DNA, 351 bp, Artificial
  Mutation in BnaC.FAD2.b introduced by TALE nuclease pair BnFAD2_T05
cctctcctccctcaccctctcccttacctcgcctggcccctctactgggcctgacaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacag

SEQ ID NO: 49966 - DNA, 353 bp, Artificial
  Mutation in BnaC.FAD2.b introduced by TALE nuclease pair BnFAD2_T05
cctctcctccctcaccctctcccttacctctcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccaccatcaagtggtacggcaagtacctcaacaaccctttgggacgcaccgtgatgttaacggttcagttcactctcggctggcctttgtacttag

SEQ ID NO: 49967 - DNA, 355 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49968 - DNA, 358 bp, Artificial
  Mutation in BnaC.FAD2.b introduced by TALE nuclease pair BnFAD2_T05
catctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49969 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccatgatgttaacggttcagttcactctcggctggcctttgtacttag

SEQ ID NO: 49970 - DNA, 345 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctctaggacgcacggtgatgctaaccgtccagttcacgctcggctggcctttgtacttag

SEQ ID NO: 49971 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49972 - DNA, 363 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49973 - DNA, 353 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 49974 - DNA, 353 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49975 - DNA, 339 bp, Artificial
  Mutation in BnaC.FAD2.b introduced by TALE nuclease pair BnFAD2_T05
cctctcctccctcaccctctctcctacttcgcctggcctctctactgggcctggcacagcaccggcaacagccgctggaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49976 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49977 - DNA, 364 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49978 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagctaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49979 - DNA, 355 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacggccaccacgccttcagcgaccaccagtggccggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49980 - DNA, 435 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49981 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 49982 - DNA, 398 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggtaatacggttatccacagaatcaggggataacggccaccacgccttcagcgaccaccagtggctggacgacgccgtgggcctcgtcttccactccttcctcctcgtcccttacttctcccggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 49983 - DNA, 323 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49984 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccacaagaagaaatccgacatcaagtggtacggaaagtacctcaacaacccgctaggacgcacggtgatgctaaccgtccagttcacgctcggctggcctttgtacttag

SEQ ID NO: 49985 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtctccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49986 - DNA, 333 bp, Artificial
  Mutation in BnaC.FAD2.b introduced by TALE nuclease pair BnFAD2_T05
cctctcctccctcaccctctctcctacttcgcctggcctgtctactgggcctgccaagggtgcgtcctaaccggcgtctgggtcatagcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49987 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49988 - DNA, 358 bp, Artificial
  Mutation in BnaC.FAD2.b introduced by TALE nuclease pair BnFAD2_T05
cctctcctccctcaccctctcccttacctcgcctggcctctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49989 - DNA, 359 bp, Artificial
  Mutation in BnaC.FAD2.b introduced by TALE nuclease pair BnFAD2_T05
cctctcctccctcaccctctcccttacctcgcctggcccctccactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagtcatcgacgccaccattccaacactggatccctcgagagggatgaagtgttcgtccccaagaagaaatccgacatcaagtggtacggaaagtacctcaacatcccgctaggacgcacggtgatgctaaccgtccagttcacgctcggctggcctgtgtacttag

SEQ ID NO: 49990 - DNA, 348 bp, Artificial
  Mutation in BnaC.FAD2.b introduced by TALE nuclease pair BnFAD2_T05
cctctcctccctcaccctctctcctacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 49991 - DNA, 353 bp, Artificial
  Mutation in BnaC.FAD2.b introduced by TALE nuclease pair BnFAD2_T05
cctctcctccctcaccctctcccttacctcgcctggcccctctattgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacacctgatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49992 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggctggccttggtacttag

SEQ ID NO: 49993 - DNA, 358 bp, Artificial
  Mutation in BnaC.FAD2.b introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49994 - DNA, 358 bp, Artificial
  Mutation in BnaC.FAD2.b introduced by TALE nuclease pair BnFAD2_T05
cctctcctccctcaccctctcccttacctcgcctggccactctactgggcctgccaaggctgcgtcctaacgggcctctgggtcatcgcccacgaatgccaccacgccttcagcgaccaccagtggctggacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 49995 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccaacatcaagtggtacggaaagtacctcaacaacccgctaggacgcacggtgatgctaaccgtccagttcacgctcggctggcctttgtacttag

SEQ ID NO: 49996 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccacggctgcgtcctcacgggcctctgggtcctcgcccacgaattcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtaaggaaagtacctcaacaacccgctaggacgcacggtgatgctaaccgtccagttcacgctcggctggcctttgtacttag

SEQ ID NO: 49997 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49998 - DNA, 364 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 49999 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtaccgcaacaacccgctaggacgcacggtgatgctaaccgtccagttcacgctcggctggcctttgtacttag

SEQ ID NO: 50000 - DNA, 283 bp, Artificial
  Mutation in BnaC.FAD2.b introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 50001 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50002 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctctaggacgcacggtgagtctaaccgtccagttcacgctcggctggcctttgtacttag

SEQ ID NO: 50003 - DNA, 430 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgagtgcgcggatggcctttttgcgtttctacaaactcttcctggctagcggtacgcgtattaattgcgttgcgctcgccaccacgccttcagcgactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50004 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50005 - DNA, 283 bp, Artificial
  Mutation in BnaC.FAD2.b introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaaggacctcaacaacccgctaggacgcacggtgatgctaaccgtccattttgcgctcgtgtggcattaatacgtag

SEQ ID NO: 50006 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50007 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctccttgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 50008 - DNA, 343 bp, Artificial
  Mutation in BnaC.FAD2.b introduced by TALE nuclease pair BnFAD2_T05
cctctcctccctcaccctctctcctacttcgcctggactctctactgggcctgccagggctgcgtcctaaccggcgtctgggtcatagcccacgagtgcggccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50009 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgacccccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggaaagtacctcaacaacccgctaggacgcgcggtgaggctaaccgtccagttcacgctcggcgggccttggtccttag

SEQ ID NO: 50010 - DNA, 435 bp, Artificial
  Mutation in BnaC.FAD2.b introduced by TALE nuclease pair BnFAD2_T05
cctctcctccctcaccctctaccttacctcgcctggcccctgtcatgcgcctgccaaggctgcgtcctaacgggcctctgggtcatctcccacgaatgccaggcccactgcttgaccccggagcaggtggtgtccatcgccggccacattggccgcacgcaggcgctggagacggccaccacgccttcagcgaccaccagtggctggacaacgccgtggacctccgcttccacgccttcctcctcgtcccttacttctcctgtaagtacagccatcgacgccaccataccaacaccggatccctcgagagggatgaagtgttcgtccccaagaagaagtcagacatcaagtggtacggcaaggacctcaacacccctttggggcgcaccgtgatgttaacggtgcagttcactgttgtgaggcctttatacttag

SEQ ID NO: 50011 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 50012 - DNA, 358 bp, Artificial
  Mutation in BnaC.FAD2.b introduced by TALE nuclease pair BnFAD2_T05
cctctcctccctcaccctctcccttacctcgcctgcttcctctactgggcctgccaaggctgcgccctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtgatacggaaattacctcaacaacccgctagggcgcacggtgatgctacccctccagttcacgctcggctggcctttgtacttag

SEQ ID NO: 50013 - DNA, 363 bp, Artificial
  Mutation in BnaC.FAD2.b introduced by TALE nuclease pair BnFAD2_T05
cctctcctccctcaccctctaccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcgaggacgcgcggtgatgctaaccgtccagttcacgctcggctggcctttgtacttag

SEQ ID NO: 50014 - DNA, 348 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatagcccacgagtgttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50015 - DNA, 363 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50016 - DNA, 283 bp, Artificial
  Mutation in BnaC.FAD2.b introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 50017 - DNA, 419 bp, Artificial
  Mutation in BnaC.FAD2.b introduced by TALE nuclease pair BnFAD2_T05
cctctcctccctcaccctctcccttacctcgccttgcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50018 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50019 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgattgtatccggccagttctcgcgcggctggccttggtacttag

SEQ ID NO: 50020 - DNA, 330 bp, Artificial
  Mutation in BnaC.FAD2.b introduced by TALE nuclease pair BnFAD2_T05
cctctcctccctcaccctctcccttacctcgcctggcctctctactgggcctgccagggctgcgtcctaaccggcgtctgggtcatagcccacgagtgctggacgacgccgtgggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50021 - DNA, 358 bp, Artificial
  Mutation in BnaC.FAD2.b introduced by TALE nuclease pair BnFAD2_T05
cctctcctccctcaccctctctcctacttcgcctggcctctttactgggccagcccagggtgcgtcctaaccgccgtctgggtcatagcccacgagtgccaccacgcctacagcgactaccagtggctggacgacaccgtcggcctcatcttccactccttcctcctcgtcccttacttctcctggaagtaccgccatcgacgccaccattccaacaccggatccctcgagatggatgaagtgttcgtccccaagaagaaatccgacatcaagtggtacggaaagtacctcaacaacccgctagaacgcacggttatgctaaccgtccagttcacgctcgtcaggcctttgtgcttag

SEQ ID NO: 50022 - DNA, 346 bp, Artificial
  Mutation in BnaC.FAD2.b introduced by TALE nuclease pair BnFAD2_T05
cctctcctccctcaccctctcccttacctcgcctggcacctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50023 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50024 - DNA, 356 bp, Artificial
  Mutation in BnaC.FAD2.b introduced by TALE nuclease pair BnFAD2_T05
cctctcctccctcaccctctcccttacctcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50025 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccaccacgccttcagcgaccaccagtggctggacggcgccgtgggcctcgtcttccactccttcctcctcgtcccttacttctcctggaagtacagccatcgacgccaccattccaacaccggatccctcgagagggatgaagtgttcgtccccaagaagaaatccgacaccaagtggtccggaaagtaccccaccaacccgctaggacgcacggtgatgctacccgtccagttcacgctcggctggcctttgtacttag

SEQ ID NO: 50026 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 50027 - DNA, 354 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggcttgacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50028 - DNA, 359 bp, Artificial
  Mutation in BnaC.FAD2.b introduced by TALE nuclease pair BnFAD2_T05
cctctcctccctcaccctctcccttacctcgcctgacccatctacagggcctgccaagactgcgtcctaacagccctctgggtcctcgcccacgaatgcgcaccacgccttcagcgaccaccagtggctggacgacgccgtgggcctcgtcttccactccttcctcctcctcccttacttctcctggaagtacggccatcgacgccaccattccaacaccggatccctcgagatggatgaagtgttcgtccccaagaagaaatccaacatcaagtggtacggaaagtaccacaacaacccgcgaggacggacggggatgctaaccgtccaagtcacgctcggctggcatttgtacttag

SEQ ID NO: 50029 - DNA, 447 bp, Artificial
  Mutation in BnaC.FAD2.b introduced by TALE nuclease pair BnFAD2_T05
cctctcctccctcaccctctcccttacctcgcctggcacctctactgggcctgccaaggctgcgtcctaacgggcctctgggtcatcgcccacgaatgctgcttgccaccattattgcttgcgatggccaccacctgctggggggtcaagccgtgggcctggcacagcaccggcaacagccgctggaccaccacgccttcagcgaccaccagtggctggacgacgccgtgggcctcgtcttccactccttcctccgcgtcccttacttctcctggaagtacagccatcgacgccaccattccaataccggatccctcgagagggatgaagggttcgtccccaagaagaaatccgacatcaagtggtacggaaagtacctcaacaacccgctaggacgcacggtgatgctaaccgtccagttcacgctcggctggcctttgtacttag

SEQ ID NO: 50030 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50031 - DNA, 357 bp, Artificial
  Mutation in BnaC.FAD2.b introduced by TALE nuclease pair BnFAD2_T05
cctctcctccctcaccctctaccttacctcgcctggcccatttactgggcctgccaaggctgcgtcctaacagccctcttggtaatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtgcctcaacaacccgctaggacgcacggggatgctaaccgtccatttcacgctcgtctggcctgtgtacttag

SEQ ID NO: 50032 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtgggcctcgtcttccactccttcctcctcgtcccttacttctcctggaagtacagccatcgacgccaccattccaacaccggatccctcgagagggatgaagtgttcgtccccaagaagaaatccgacataaagtggtacggaaagtacctcaacaacccgctaggacgcacggtgatgctaaccgtccagttcacgctcggctggcctttgtacttag

SEQ ID NO: 50033 - DNA, 358 bp, Artificial
  Mutation in BnaC.FAD2.b introduced by TALE nuclease pair BnFAD2_T05
cctctcctccctcaccctctcccctacttcgcctggactctctactgcgcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagctcacgctcggctggcctttgtacttag

SEQ ID NO: 50034 - DNA, 357 bp, Artificial
  Mutation in BnaC.FAD2.b introduced by TALE nuclease pair BnFAD2_T05
cctctcctccctcaccctctcccttacctcgcctggcccctctactgcgcctgacaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaagccgacatcaagtggtacggaaagttcctcaacaacccgctaggacgcacggtgatgctaaccgtccagttcacgctcggctggcctttgtgcttag

SEQ ID NO: 50035 - DNA, 447 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccgccattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctgtgtacttag

SEQ ID NO: 50036 - DNA, 347 bp, Artificial
  Mutation in BnaC.FAD2.b introduced by TALE nuclease pair BnFAD2_T05
cctctcctccctcaccctctatcctacttcgcctggcctctctactgggcctgccaagggtgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 50037 - DNA, 435 bp, Artificial
  Mutation in BnaC.FAD2.b introduced by TALE nuclease pair BnFAD2_T05
cctctcctccctcaccctctaccttacctcgcctggcccctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtccggcaagtacctcaacacccctttgggacgcaccgtgatgttaacggttcagttcactctcggctggcctttgtacttag

SEQ ID NO: 50038 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaccgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggtgcagttcactcgcggctggcctgtgtacttag

SEQ ID NO: 50039 - DNA, 358 bp, Artificial
  Mutation in BnaC.FAD2.b introduced by TALE nuclease pair BnFAD2_T05
cctctcctccctcaccctctcccttacctcgcctggcccctctcctgggcctgccaaggacgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaggtgttcgtccccaagaagaaatccgacatcaagtggtacggaaagtacctcagcaaccggctaggacgcacggtgagtcttagcgtccagttcaggctcggctggcctttgtgcttag

SEQ ID NO: 50040 - DNA, 419 bp, Artificial
  Mutation in BnaC.FAD2.b introduced by TALE nuclease pair BnFAD2_T05
cctctcctccctcaccctctcccttacctcgcctgcaccctctactgagcctgccaaggctgcgtcctaacgggccggcaggcgctcccttgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgggcagttcacgctgggttggcctgtgtacttag

SEQ ID NO: 50041 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 50042 - DNA, 358 bp, Artificial
  Mutation in BnaC.FAD2.b introduced by TALE nuclease pair BnFAD2_T05
cctctcctccctcaccctctctcctacttcgcctggcccctctactgggcctgccagggctgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50043 - DNA, 355 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagccatcgacgccaccattccaacaccggatccctcgatagggatgaagtgttcgtccccaagaagaaatccgacatcaagtggtacggaaagtacctcaacaacccgctaggacgtacggtgatgctaaccgtccagttcacgctcggctggcctttgtacttag

SEQ ID NO: 50044 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50045 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcacagtgatgttaacggttcagttcactctcggctggcctttgtacttag

SEQ ID NO: 50046 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctacccgccccgctcacgctcggctggcctttgtacttag

SEQ ID NO: 50047 - DNA, 354 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgactaccagtggctggacgacaccgtcggcctcatcttccactccttcctcctcgtcccttacttcgcctggaagtacagtcagcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccctttgtacttag

SEQ ID NO: 50048 - DNA, 360 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggtaccacgccttcagcgactaccagtggctggacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 50049 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50050 - DNA, 358 bp, Artificial
  Mutation in BnaC.FAD2.b introduced by TALE nuclease pair BnFAD2_T05
cctctcctccctcaccctctctcctacttcgcctggcctctctcctgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaagccgacatcaagtggtacggaaagtacctcaacaacccgctaggacgcacggggatgctaaccgtccagttcacgcgcggctggcctgtgtacttag

SEQ ID NO: 50051 - DNA, 430 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaggcccacggcaacagccgctggaccgtctccagcgcctgcttgccaccattattgctggcgattgccacccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50052 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50053 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 50054 - DNA, 350 bp, Artificial
  Mutation in BnaC.FAD2.b introduced by TALE nuclease pair BnFAD2_T05
cctctcctccctcaccctctctcctacttcgcctggcctctctactgggcctgccagggctgcgccctaaccggcgtctgggtcatagccctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtaccgcagcaacccgctaggacgcacgatgatgctaaccgtccagttcacgctcggctggcctttgtacttag

SEQ ID NO: 50055 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctagtacgcacggtgatgctaaccgtccagttcacgctcggctggcctttgtacttag

SEQ ID NO: 50056 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50057 - DNA, 347 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50058 - DNA, 357 bp, Artificial
  Mutation in BnaC.FAD2.b introduced by TALE nuclease pair BnFAD2_T05
cctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 50059 - DNA, 356 bp, Artificial
  Mutation in BnaC.FAD2.b introduced by TALE nuclease pair BnFAD2_T05
cctctcctccctcaccctctcacctacttcgcctggcctctctactgggcctgccagggctgcgtcctaaccggcgtctgggtcatagcccacgagccaccacgccttcagcgaccaccagtggctggacgacgccgtgcgcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50060 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcagctggcctttgtacttag

SEQ ID NO: 50061 - DNA, 383 bp, Artificial
  Mutation in BnaC.FAD2.b introduced by TALE nuclease pair BnFAD2_T05
cctctcctccctcaccctctcccttacctcgcctggcctctctactgggcctgccagggctgcgtcctaactggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50062 - DNA, 392 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcttctagctgataaattcatgccggagagggtggccaccacgccttcagcgactaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50063 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccacttcttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50064 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctcttggtcatcgcccacgacaccacgccttcagcgaccaccagtggctggacgacgccgttggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50065 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50066 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50067 - DNA, 287 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgtcccttacttctcctggaagtacagtcatcgacgccaccattccaacaccggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50068 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacggccctctgggtcatcgcccacgaatgccaccacgccttcagcgaccaccagtggctggaccacgccgtgggcctcgtcttccactccttccgccccgtcccttacttcccctggaagtccagccatcgacgccaacatgccaacaccggatccctcgagagggatgaagtgttcgtccccaagaagaaagccgacaacaagtggtacggaaagtacctcaacaacccgctaggacgcacggtgatgctaaacgtgcagttcacgctcgactggccttagtaccaag

SEQ ID NO: 50069 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50070 - DNA, 347 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccaactaccagtggctggacgacaccgtgggcctcgtcttccactccttcctcctcgtaccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50071 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50072 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50073 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagcggtacggaaagtacctcaacaacccgctaggacgcacggtgatgctaaccgtccagttcacgctcggctgacctttgtacttag

SEQ ID NO: 50074 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaacctgcgtctgggtcatagcccacgagtgccaccacgccttcagcgactaccagtggcttgacgacaccgtgggcctcgtcttccactccttcctcctcgtcccttacttctcctggaagtacagccatcgacgccaccattccaacactggctccctcgagagagacgaagtgtttgtccccaagaagaaatccgacatcaagtggtacggaaagtaccccaacaacccgctaggccgcgtggtatggctaaccgtgcaggcgtctcctggttggccgttgtacgtaa

SEQ ID NO: 50075 - DNA, 340 bp, Artificial
  Mutation in BnaC.FAD2.b introduced by TALE nuclease pair BnFAD2_T05
cctctcctccctcacccttacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 50076 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcaaccaccagtggctggacgacgccgtgagcctcgtcctccactccttcctcctcgtcccttacttctcctggaagtacagccatcgacgccaccattccaacaccggatccctcgagagggatgaagtgtacgtccccaagaagaaacccagcatcaagtggtacggaaagtacctcaacagcccgcaaggacgcacggtgatgctaaccgtccagttcacgctcggctggcctttgtacttag

SEQ ID NO: 50077 - DNA, 357 bp, Artificial
  Mutation in BnaC.FAD2.b introduced by TALE nuclease pair BnFAD2_T05
cctctcctccctcaccctctcccttacctcacctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50078 - DNA, 339 bp, Artificial
  Mutation in BnaC.FAD2.b introduced by TALE nuclease pair BnFAD2_T05
cctctctccctcaccctctcccttacctcgcctggcccctctactgggcctgccaaggctgcgtcctaacgggcctctgggtcatcgcccacgagtgctaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctgccctttgtacgtag

SEQ ID NO: 50079 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 50080 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagcggctggacgacgccgtgggcctcgtcttccactccttcctcctcgtcccttacttctcctggaggtacagccatcgacgccaccattccaacaccggctccctcgagagagatgaagtgttcgtccccaagaagaaatccgacatcaagtggtacggcaagtacctcaacaacccgctaggacgcacggtgatgctaacggtccagttcacgctcggctggcctttgtacttag

SEQ ID NO: 50081 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50082 - DNA, 354 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50083 - DNA, 371 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgcctgcttgccaccgccatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50084 - DNA, 359 bp, Artificial
  Mutation in BnaC.FAD2.b introduced by TALE nuclease pair BnFAD2_T05
cctctcctccctcaccctctcccttacctcgcctggaccctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttaggacgctccgtgatgttaaccgtccagttcacgctcggctggcctttgtacttag

SEQ ID NO: 50085 - DNA, 359 bp, Artificial
  Mutation in BnaC.FAD2.b introduced by TALE nuclease pair BnFAD2_T05
cctctcctccctcactctctcccttacctcgcctggcccctctactgagcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtccctcaacagccctgtgggacgcgccttgatgttaacgtttcatttcactctcggcggccctttgtacttag

SEQ ID NO: 50086 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtgcttag

SEQ ID NO: 50087 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgcgtacttag

SEQ ID NO: 50088 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagcacctcaacaacccgctaggacgcacggtgatgctaaccgtccagttcacgctcggctggcctttgtacttag

SEQ ID NO: 50089 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacgccgtgggcctcgtcttccactccttcctcctcgtcccttacttctcctggaagtacagccatcgacgccaccattccaacaccggatccctcgagagggatgaattgttcgtccccaagaagaaatccgacatcaagtggtacggaaagtacctcaacaacccgctaggacgcacggtgatgctaaccgtccagttcacgctcggctggcctttgtacttag

SEQ ID NO: 50090 - DNA, 398 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggtaatacggttatccacagcatcaggggataacggccaccacgccttcagcgaccaccagtggctggacgacgccgtgggcctcgtcttccactccttcctcctcgtcccttccttctcctggaagtacagccatcgacgccaccattccaacaccggatccctcgagagggatgaagtgttcgtccccaagaagaaatccgacatcaagtggtgcggaaagtacctcaacaacccgctaggacgcacggtgatgctaaccgtccagttcacgctcggctggcctttgtacctag

SEQ ID NO: 50091 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgagtaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50092 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatcccacatcaagtggtacggaaagtacctcaacaacccgctaggacgcacggtgaggctaaccgtccagttcacgctcggctggccttggtacttag

SEQ ID NO: 50093 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50094 - DNA, 278 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggccactccttcctcctcgtcccttacttctcctggaagtagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50095 - DNA, 443 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50096 - DNA, 371 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtaccgcaacaacccgcgaggacgcacggtgatgctaaccgtccagttcacgctcggctggcctttgtacttag

SEQ ID NO: 50097 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 50098 - DNA, 357 bp, Artificial
  Mutation in BnaC.FAD2.b introduced by TALE nuclease pair BnFAD2_T05
cctctcctccctcaccctctctcctacttcgcctagccactctactgggcctgccaaggctgcgtcctaacgggcctctgggtcatcgcccacggatgcaccactccttcagcgaccaccggtggctggccgccgccgtcggcctcgtcttccactccttcctcctcgtcctttacttctcctggcagtacagccatcgacgccaccattccaacacccgctccctcgagagggatgaagtgttcgtccccaagaagaaaccccacatcaagtggtacggaaagtacctcaacaacccgctaggacgcacggtgatgctaaccgtccagttcacgctcggctggccttcgtacttcg

SEQ ID NO: 50099 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggcttgacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 50100 - DNA, 394 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgacaaacaacagataaaacgaaaggcccagtcttcccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50101 - DNA, 350 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50102 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgtagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50103 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatctaccatgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 50104 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgcaccacgccttcagcgaccaccagtggctggacgacgccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50105 - DNA, 359 bp, Artificial
  Mutation in BnaC.FAD2.b introduced by TALE nuclease pair BnFAD2_T05
actctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaagccgacatcaagtggtacggaaagttcctcaacaacccactagcgcgcacgttgatgctaaccggccatttctcgcccgtctgtcctttgtgcttag

SEQ ID NO: 50106 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtacccaagaagaagtcagacatcaagtggtacggcaagtacctcaacaaccctttgggacgcaccgtgatgttaacggttcagttcactctcggctggcctttgtacttag

SEQ ID NO: 50107 - DNA, 361 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctggtcatagcccacgagtgcggcccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgcccttagtacttag

SEQ ID NO: 50108 - DNA, 328 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50109 - DNA, 360 bp, Artificial
  Mutation in BnaC.FAD2.b introduced by TALE nuclease pair BnFAD2_T05
cctctcctccctcaccctctcccttacctcgcctggcacctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaataagaaatccgacatcaagtggtacggaaagtacctcaacaacccgctaggacgcacggtgatgctaaccgtccagttcacgctcggctggcctttgtacttag

SEQ ID NO: 50110 - DNA, 410 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatattggtggcaagcaggcgctggagacggtgcaggcgctgttgccggtgctgtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagcagaaacccgacatcaagtgttacggaaagtacctcagcaaccctctaggacgcacggtgaggcttaccgcccagttcacgcccgcctgccctcagtacctag

SEQ ID NO: 50111 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagggatgaggtgttcgtccccaagaagaaatccgacatcaagtggtacggaaagtacctcaacaacccgctaggacgcacggtgatgctaaccgtccagttcacgctcggctggcctttgtacttag

SEQ ID NO: 50112 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 50113 - DNA, 283 bp, Artificial
  Mutation in BnaC.FAD2.b introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50114 - DNA, 443 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 50115 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcgtctggcctttgtgcttag

SEQ ID NO: 50116 - DNA, 356 bp, Artificial
  Mutation in BnaC.FAD2.b introduced by TALE nuclease pair BnFAD2_T05
cctctcctccctccccctctctcctacttctcctggcctctctactgggcctgcccagggtgcgtcctaaccggcgtctgggtcatagcccacgagtgaccacaccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtccggaaagtacctcaacaacccgctaggacgcacggtgatgctaaacgtccagttcacgcccggctggcctttgtccttag

SEQ ID NO: 50117 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50118 - DNA, 348 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50119 - DNA, 441 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcaagcaggcgctggagacggtccagcggctgttgccggtgctgtgccatggggggtcaatccgtggtcctggcacagcaccggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaagccgacatcaagtggtacggaaagtaccccaacaacccgctaggccgcacggtgatgctaaccgtccaggtcacgctcggctgccctgagtacttag

SEQ ID NO: 50120 - DNA, 358 bp, Artificial
  Mutation in BnaC.FAD2.b introduced by TALE nuclease pair BnFAD2_T05
cctctcatccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 50121 - DNA, 435 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccatcccaacaccggatccctcgagagggatgaagtgttcgtccccaagaagaaatccgacatcaagtggtacggaaagtacctcaacaacccgctaggacgcacggtgatgctacccgtccagttcacgctcggctggcctttgtacttag

SEQ ID NO: 50122 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcgtctgggtcatcgaccacgaatgcagccacgccttcagcgaccaccagtggctggacgacgccgtcggcctcgtcttctcctccttcctcctcgtcccttacttctcctggaagtagagccatcgacgccaccattccaacacaggcttcctcgagagagaggaagggttcgtccccaagaagaaatccgacatcaagtggtacgggaaggtcccaaagaacccgctagaacggacgttgatgctaaccgtacgggtcaggcgcgccgggcctttgtacttag

SEQ ID NO: 50123 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 50124 - DNA, 359 bp, Artificial
  Mutation in BnaC.FAD2.b introduced by TALE nuclease pair BnFAD2_T05
cctctcctccctcaccctctctcctacttcgcctggcctctctactgagcctgccagggctgcgtcctaaccagcgtctgggtcatagcccacgagtgcggaccacgccttcagcgactaccagtggctggacgacgccgtgggcctcgtcttccactccttcctcctcgtcccttacttctcctggaagtacagccatcgacgccaccattccaacaccggatccctcgagagggacgaagtgttcgtccccaataagaaacccgacatcaagtcgtacggaaagtacctcaacaaccggctaggacgcactgtgaggcttaccctccaggtcaggctcggctgcccttagcacttag

SEQ ID NO: 50125 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggaaagtacctcaacaacccgctaggacgcacggtgatgctacccgtccagttcacgctcggctggcctttgtacttag

SEQ ID NO: 50126 - DNA, 355 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaaccggcgtctgggtcatagcccacgagtaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50127 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcacttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50128 - DNA, 353 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaagccgacagcaagtggtacggaaagtacctcaacaacccgctaggacgcacggtgatgctaaccgtccagttcacgctcggctggcctttgtacttag

SEQ ID NO: 50129 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcacgcgcgcctggcctttgtacttag

SEQ ID NO: 50130 - DNA, 350 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50131 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctggcctttgtacttag

SEQ ID NO: 50132 - DNA, 419 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacaccggatccctcgagagtgatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50133 - DNA, 364 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagcggctggacgacgccgtgggcctcgtcttccactccttcctcctcgtcccttacttctcctggaagtacagccatcgacgccaccattccaacaccggatccctcgagagggatgaagtgttcgtccccaagaagaaagccgacatcaagtggtacggaaagtacctcaacaacccgctagaaggcgcggtgatgctaaccgtccagttcacgctcgccttgcctttgtacttag

SEQ ID NO: 50134 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50135 - DNA, 355 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50136 - DNA, 443 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccttggggacgcaccgtgatgttaacggttcagttcactctcggctggcctttgtacttag

SEQ ID NO: 50137 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactcag

SEQ ID NO: 50138 - DNA, 333 bp, Artificial
  Mutation in BnaC.FAD2.b introduced by TALE nuclease pair BnFAD2_T05
cctctcctccctcaccctctcccttacctcgcctgccccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 50139 - DNA, 358 bp, Artificial
  Mutation in BnaC.FAD2.b introduced by TALE nuclease pair BnFAD2_T05
cctctcctccctcaccctctcccttacctcgcctagcccctctactgggcctgccaaggctgcgtcctaacgggcctctgggtcatcgcccacgaatgccaccacgcattcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgctcggtgatgctaaccgtccagtgcacgctcggctggccgttgtacttag

SEQ ID NO: 50140 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50141 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccacaccgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgttcagttcacgctcggctggcctttgtacttag

SEQ ID NO: 50142 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgatgatggaagtaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggaagcacggtgatgctaaccgtccagttcacgctcggctggcctttgtacttag

SEQ ID NO: 50143 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgcgaaccgtccagttcacgcgcggctggcctttgtacttag

SEQ ID NO: 50144 - DNA, 283 bp, Artificial
  Mutation in BnaC.FAD2.b introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgattctaaccgtccagttcacgctcggctggcctttgtacttag

SEQ ID NO: 50145 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50146 - DNA, 363 bp, Artificial
  Mutation in BnaC.FAD2.b introduced by TALE nuclease pair BnFAD2_T05
cctctcctccctcaccctctccattacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttggacttag

SEQ ID NO: 50147 - DNA, 359 bp, Artificial
  Mutation in BnaC.FAD2.b introduced by TALE nuclease pair BnFAD2_T05
cctctcctccctcaccctttatactacttcgcctggcctctctactgggcctgccaagggtgcgtcctaaccggcgtctgggtcatagcccacgagtgaccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctccgctggcctttgcacttag

SEQ ID NO: 50148 - DNA, 333 bp, Artificial
  Mutation in BnaC.FAD2.b introduced by TALE nuclease pair BnFAD2_T05
cctctcctccctcaccctctcccttacctcgcctggcccctctcctgagcctgccaaggctgcgtcctaacaagcctctgagtcatcgcccacgaatgtggctggacgacgccgtgggcctcgtcatccactccttcctcctcgtcccttacttctcctggaagtacagccatcgacgccaccattccaacactggctccctcgagagagacgaagtgtttgtccccaagaagaagtcagacatcaagtggtacggaaagtacctcaacaaccggctaggacgcacggtgaggctaaccgcccagttcacgctcggctgcccttagtgcttag

SEQ ID NO: 50149 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtgcttag

SEQ ID NO: 50150 - DNA, 354 bp, Artificial
  Mutation in BnaC.FAD2.b introduced by TALE nuclease pair BnFAD2_T05
cctctcctccctcaccctctcccttacctcgcctggcccctctcctgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctctaggacgctcggtgacgctcaccgtccagttcactctcggctggcctttgtacttag

SEQ ID NO: 50151 - DNA, 357 bp, Artificial
  Mutation in BnaC.FAD2.b introduced by TALE nuclease pair BnFAD2_T05
cctctcctccctcaccctctcccttacctcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 50152 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtactta

SEQ ID NO: 50153 - DNA, 353 bp, Artificial
  Mutation in BnaC.FAD2.b introduced by TALE nuclease pair BnFAD2_T05
cctctcctccctcaccctctcccttacctcgcctggcccctctactgtgcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50154 - DNA, 357 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50155 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccgtatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50156 - DNA, 435 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcattgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttcgtacttcg

SEQ ID NO: 50157 - DNA, 332 bp, Artificial
  Mutation in BnaC.FAD2.b introduced by TALE nuclease pair BnFAD2_T05
cctctcctccctcaccctctcccttacctcgcctgtcccctctactaagcctgccaaggctgcgtcctaacgagcctctgggtcatcgcccacgaatgtggctggacgacgccgtgggcctcgtcttccactccttcctcctcgtcccttgcttctcctggaagtacagccatcgacgccaccattccaacaccggatccctcgagagggatgaagtgttcgtccccaagaagaaatccgacatcaagtggtacggaaagtacctcaacaacccgctagtacgcccggtgatgctcaccgtccagttcacgctcggctcgcttgtgtactag

SEQ ID NO: 50158 - DNA, 364 bp, Artificial
  Mutation in BnaC.FAD2.b introduced by TALE nuclease pair BnFAD2_T05
cctctcctccctcaccctgtcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcctccccaagaagaaatccgacatcaagtggtacggaaagtacctcaacaacccgctaggacgcacggtgatgctaaccgaccagttcacgctcggctggccgttgtacttag

SEQ ID NO: 50159 - DNA, 328 bp, Artificial
  Mutation in BnaC.FAD2.b introduced by TALE nuclease pair BnFAD2_T05
cctctcctccctcaccctctcccttacctcgcctggaccctctactgggcctgccaaggctgcgtcctaacgggcctctgggtcatcgcccacgagtgcgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50160 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 50161 - DNA, 383 bp, Artificial
  Mutation in BnaC.FAD2.b introduced by TALE nuclease pair BnFAD2_T05
cctctcctccctcaccctctatcctacttcgcctggcctctctactgggcctgccagggctgcgtcctaaccggcgtctgggtcatagcccacgagtgcggcctccagcggctgttgccggtgccaccacgccttcagcgactaccagtggctggacgacaccgtcggcctcatcttccactccttcctcctcgtcccttacttctcctggaagtacagccatcgacgcctccattccaacaccggatccctcgagagggatgaagtgttcgtccccaagaagaaatccgacatcaagtggtacgggaagtacctcaacaacccgctaggacgcacggtgatgctaaccgtccagttcacgctcggctggcctttgtacttag

SEQ ID NO: 50162 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 50163 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgattctaaccggccagttcactctcggctggcctttgtacttag

SEQ ID NO: 50164 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgaggctaaccgtccagttcacgctcggctggcctttgtacttag

SEQ ID NO: 50165 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctacccgtccagttcacgctcggctggcctttgtacttag

SEQ ID NO: 50166 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactcag

SEQ ID NO: 50167 - DNA, 419 bp, Artificial
  Mutation in BnaC.FAD2.b introduced by TALE nuclease pair BnFAD2_T05
cctctcctccctcaccctctctcctacttcgcctggcccccctactgagcctgccaaggatgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacaccggatccctcgagagggatgaagggttcgtccccaagaagaaatccgacatcaagtggtacggaaagtaccttaacaccccgctaggtcgcccggtgatgctcaccgtccatgtcacgctcggctggcctttgtacttag

SEQ ID NO: 50168 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgaccaccagtggctggacgacgccgtgggcctcgtcctccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggccattgtacttag

SEQ ID NO: 50169 - DNA, 361 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggtaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacagcaagtggtacggaaagtacctcaacaacccgctaggacgcacggtgatgctaaccgtccagttcacgctcggctggcctttgtcccttag

SEQ ID NO: 50170 - DNA, 357 bp, Artificial
  Mutation in BnaC.FAD2.b introduced by TALE nuclease pair BnFAD2_T05
cctctcctccctcaccctctcccttacctcgcctggccactctaatgggcctgccaaggatgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50171 - DNA, 419 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgggatgttaacggttcagttcactctcggctggcctttgtacttag

SEQ ID NO: 50172 - DNA, 345 bp, Artificial
  Mutation in BnaC.FAD2.b introduced by TALE nuclease pair BnFAD2_T05
cctctcctccctcaccctctcccttacctcgcctggcccctctcctgggcctgccaaggctgcgtcctaacgggcctctgggtcatcaccacgccttcagcgaccaccagtggctggacgacgccgtgggcctcgtcttccactccttcctcctcttcccttacttctcctggaagtacagtcatcgacgccaccattccaacaccggctccctcgagagagacgaagtgtttgtccccaagaagaagtctgacatcaagtggtacggaaagtacctcaacaaccgtctgggacgcacggtgatgctaaccgttcagttcacgctcggctggcctttgtacttag

SEQ ID NO: 50173 - DNA, 346 bp, Artificial
  Mutation in BnaC.FAD2.b introduced by TALE nuclease pair BnFAD2_T05
cctctcctccctcaccctctcccttacctcgcctggaccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50174 - DNA, 357 bp, Artificial
  Mutation in BnaC.FAD2.b introduced by TALE nuclease pair BnFAD2_T05
cctctcctccctcaccctctcccttacctcgcctggcccctctactcggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50175 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50176 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggcttgacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50177 - DNA, 357 bp, Artificial
  Mutation in BnaC.FAD2.b introduced by TALE nuclease pair BnFAD2_T05
cctctcctccctcaccctctcccttacctcgcctggccccactactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatcccccgagagggatgaagtgttcgtccccaagaagaaatccgacatcaagtggtacggaaagtacctcaacaacccgctaggacgcacggtgatgctaaccgtccagttcacgctgggctggccttgtacttag

SEQ ID NO: 50178 - DNA, 435 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 50179 - DNA, 357 bp, Artificial
  Mutation in BnaC.FAD2.b introduced by TALE nuclease pair BnFAD2_T05
cctctcctccctcaccctctcacttacctcgccttgcccctctcctaagcctgccaaggctgcgtcctaccagccctctgggtcatcgcccacgaatgcaccacgccttcagcgaccaccagtggctggacgacaccgtgggcctcgtcttccactccttcctcctcgtcccttacttctcctggaagtacagccatcgacgccaccattccaacaccggatcgctcgagagggatgaagtgttcgtccccaagaagaaatccgacatcaagtggtacggaaagtacttcaacaacccgctgggacgcacggtgatgttaaccttgcaggtcacgctcggctggcctttatacttag

SEQ ID NO: 50180 - DNA, 465 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcccatcgccagcaatattggtggcaagcaggcgctggagacggtgccaggcccacggcttgaccccggagcaggtggtggccatcgccagcaatattggtggcaagcaggaaccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 50181 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttcagcgactaccagtggcttgacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50182 - DNA, 396 bp, Artificial
  Mutation in BnaC.FAD2.b introduced by TALE nuclease pair BnFAD2_T05
cctctcctccctcaccctctctcctacttcgcctggcctctctactgggccatcgccagcaataatggtggcaagcaggcgctggagacggtccagcggctgttgccggtgctgtgccaggcccacggcttgacccccaccacgccttcagcgactaccagtggctggacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50183 - DNA, 323 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtgcggccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 50184 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50185 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50186 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgcccacgaatgcaccacgccttcagcgaccaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50187 - DNA, 419 bp, Artificial
  Mutation in BnaC.FAD2.b introduced by TALE nuclease pair BnFAD2_T05
cctctcctccctcaccctctcccttacctcgcctggcccctctactcggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacaccgtgggcctcgtcttccactccttcctcctcgtcccttacttctcctggaagtacagccagcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 50188 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 50189 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgttaaccgtacagttcacgctcggctggcctttgtacttag

SEQ ID NO: 50190 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50191 - DNA, 357 bp, Artificial
  Mutation in BnaC.FAD2.b introduced by TALE nuclease pair BnFAD2_T05
cctctcctccctcaccctctcacttacctcgcctggcccatctcctgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcttgaacgcacggtgatgctaaccgtgcaggtcacgctcggctggcctgtgtacttag

SEQ ID NO: 50192 - DNA, 280 bp, Artificial
  Mutation in BnaC.FAD2.b introduced by TALE nuclease pair BnFAD2_T05
cctctcctccctcaccctctctactacttcgcctggcctctctactgggcctgccaagggtgcgtcctaaccggccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 50193 - DNA, 356 bp, Artificial
  Mutation in BnaC.FAD2.b introduced by TALE nuclease pair BnFAD2_T05
cctctcctccctcaccctctctcctacttcgcctggcctctctcctgggcctgccagggctgcgtcctaaccggcgtctgtgtcatagcccacgagtgcacacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50194 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtgccaccacgccttcagcgactaccagtggctggacgacaccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctgggacgcacggtgatgctaaccgtccagttcacgctcggctggcctttgtacttag

SEQ ID NO: 50195 - DNA, 346 bp, Artificial
  Mutation in BnaC.FAD2.b introduced by TALE nuclease pair BnFAD2_T05
cctctcctccctcaccctctcccttaccccgcctggcccctctactgggcctgccaagtctgcgccctaacgggcctctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacgccccggatggatgcaaggtaatgctaaccgtccagttcactctcggctggcctttgtacttag

SEQ ID NO: 50196 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50197 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacaggcgtctgggtcatagcccacgagtgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaacgttccagttcactctccgctagcctgtgtacttag

SEQ ID NO: 50198 - DNA, 355 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50199 - DNA, 358 bp, Artificial
  Mutation in BnaC.FAD2.b introduced by TALE nuclease pair BnFAD2_T05
cctctcctccctcaccctctctcctacttcgcctggcccctctactgagcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggatggcctttgtacttag

SEQ ID NO: 50200 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50201 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 50202 - DNA, 447 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccattattgctggcgatggccaccacctgctgggggatcaagccgtgggcctggcacagcaccggcaacagccgctggaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50203 - DNA, 394 bp, Artificial
  Mutation in BnaC.FAD2.b introduced by TALE nuclease pair BnFAD2_T05
cctctcctccctcaccctctcccttacctcgcctggcccctctactgcgcctgccaaggctgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 50204 - DNA, 363 bp, Artificial
  Mutation in BnaC.FAD2.b introduced by TALE nuclease pair BnFAD2_T05
cctctcctccctcaccatctcccttacctcgcctggcccctctactgggcctgccaaggctgcgtcctaacgggcctctgggtcatagcccacgagtgcggcgccaccacgccttcagcgactaccagtggctggacgacaccggcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50205 - DNA, 441 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaagcaggcgctggagacggtccagcggctgttgccggtgctgtgccatggggggtcaagccgtgggcctggcacagcaccggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50206 - DNA, 358 bp, Artificial
  Mutation in BnaC.FAD2.b introduced by TALE nuclease pair BnFAD2_T05
cctctcctccctcaccctctcacttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctgtgtacttag

SEQ ID NO: 50207 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 50208 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggtctcatcttccactccttcctcctcgtcccttacttctcctggaagtacagccatcgacgccaccattccaacaccggatcccccgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50209 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagcggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50210 - DNA, 403 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagcaggtggtggccatcgccagcaataatggtggcaagcaggcgctggagaaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50211 - DNA, 398 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgcggcggtaatacgggtatccacagaatcaggggataacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50212 - DNA, 342 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50213 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50214 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50215 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaagacgcacggtgatgctaaccgtccagttcacgctcggctggcctttgtacttag

SEQ ID NO: 50216 - DNA, 330 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaacggcgtctgggtcatagcccacgagtgctggacgacaccgtcggcttcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcgcggtgatgctaaccgtccagttctcgctcggctggccgttgtacttag

SEQ ID NO: 50217 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50218 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtaaggaaagtacctcaacaacccgctaggacgcacggtgatgctaaccgtccagttcacgctcggctggcctttgtacttag

SEQ ID NO: 50219 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 50220 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 50221 - DNA, 345 bp, Artificial
  Mutation in BnaC.FAD2.b introduced by TALE nuclease pair BnFAD2_T05
cctctcctccctcaccctctcacttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctctagagggatgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 50222 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 50223 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 50224 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50225 - DNA, 356 bp, Artificial
  Mutation in BnaC.FAD2.b introduced by TALE nuclease pair BnFAD2_T05
cctcccctcctcaccctctctcctacttcgcctggcctctctactgggcctgccaagggtgcgtcctaaccggcgtctgggtcatagcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaacccgctaggacgcacggggatgctaaccgtccagttcacgctcggctggcctttgtacttag

SEQ ID NO: 50226 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgactaccagtggctggacgccaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgagtacttag

SEQ ID NO: 50227 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggaaagtacctcaacaacccgctaggacgcacggtgatgctaaccgtccagttcacgctcggctggcctttgtacttag

SEQ ID NO: 50228 - DNA, 398 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggtaatacggttatccacagaatcaggggataacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacagcccgctaggacgcacggtgatgctaaccgtccagttcacgctcggctggcctttgtacttag

SEQ ID NO: 50229 - DNA, 323 bp, Artificial
  Mutation in BnaC.FAD2.b introduced by TALE nuclease pair BnFAD2_T05
cctctactccctcaccctctctcctacttcgcctggcctctctactgggcctgccaagggtgcgtcctaaccggcgtctgggtcatagcccacgagtgcggccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50230 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccatttcacgctcggctggcctttgtacttag

SEQ ID NO: 50231 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggccggcctttgtacgtag

SEQ ID NO: 50232 - DNA, 358 bp, Artificial
  Mutation in BnaC.FAD2.b introduced by TALE nuclease pair BnFAD2_T05
cctctcctccctcaccctctctcctacttcgcctggcctctctactaggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50233 - DNA, 364 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgcggctgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50234 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50235 - DNA, 354 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 50236 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 50237 - DNA, 354 bp, Artificial
  Mutation in BnaC.FAD2.b introduced by TALE nuclease pair BnFAD2_T05
cctctcctccctcaccctctcccttacctcgcatggcccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggaagcacggtgatcctaaccgtcccgtgcacgctcggctggcctttgtacttag

SEQ ID NO: 50238 - DNA, 346 bp, Artificial
  Mutation in BnaC.FAD2.b introduced by TALE nuclease pair BnFAD2_T05
cctctcctccctcaccctctaccttacctcgcctggccactctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggtcgcacggtgatgctaaccgtccagttcacgctcggctggccgttgtacttag

SEQ ID NO: 50239 - DNA, 410 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctcttggtcatcgcccacgaatattggtggcaagcaggcgctggagacggtgcaggcgctgttgccggtgctgtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50240 - DNA, 447 bp, Artificial
  Mutation in BnaC.FAD2.b introduced by TALE nuclease pair BnFAD2_T05
cctctcctcactcaccctctcccttacctcgcctggcccctctactgggcctgccaaggctgcgtcctaacgggcctctgggtcatcgcccacgaatgctgcttgccaccattattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccttcgagttcacgctcggctggcctttgtacttag

SEQ ID NO: 50241 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 50242 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgctcgtccccaagaagaaatccgacatcaagtggtacggaaagtacctcaacaacccgctaggacgcacggtgatgctatccgtccagttcacgctcggctggcctttgtacttag

SEQ ID NO: 50243 - DNA, 359 bp, Artificial
  Mutation in BnaC.FAD2.b introduced by TALE nuclease pair BnFAD2_T05
cctctcctccctcaccctctaccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattcgaacaccggatccctcgagagggatgaagtgttcgtccccaagaagaaatccgacatcaagtggtacggaaagtacctcaacaacccgctagtacgcacggtgatgctaaccgtccagttcacgctcggctgtcctttgtacttag

SEQ ID NO: 50244 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50245 - DNA, 447 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccattattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacttcgcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50246 - DNA, 351 bp, Artificial
  Mutation in BnaC.FAD2.b introduced by TALE nuclease pair BnFAD2_T05
cctctcctccctcaccctctcccttacctcgcctggcctctctactgggcctgccaagggtgcgtcctaaccggcgtctgggtcatagcccacgagacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50247 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatcctacatcaagtggtacggaaagtacctcaacaacccgctaggacgcacggtgatgctaaccgtccagttcacgctcggctggcctttgtacttag

SEQ ID NO: 50248 - DNA, 443 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgagtgcctcaagccgtgggcctggtccagcggctgttgccaccgccattgctggcgatggccaccacctgctggggggtcaagccgtgtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50249 - DNA, 392 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaacgaaacccgacaggactataaagataccaggcgtttccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 50250 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 50251 - DNA, 355 bp, Artificial
  Mutation in BnaC.FAD2.b introduced by TALE nuclease pair BnFAD2_T05
cctctcctccctcaccctctctcctacttcgcctggcctctctactgagcctgccagggctgcgtcctaaccggcgtctgggtcatagcccacgagtaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50252 - DNA, 443 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgaatgcggccgctcaacttgaccccggagcaggtggtggccatcgccatgcctcctctagaccagccaggacagaaatgcctcgacttcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50253 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgatcggctggcctttgtacttag

SEQ ID NO: 50254 - DNA, 364 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 50255 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccgccattccaacactggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50256 - DNA, 283 bp, Artificial
  Mutation in BnaC.FAD2.b introduced by TALE nuclease pair BnFAD2_T05
cctctcctccctcaccctctcccttaccacgccttcatcgactaccagtggcttgacgacaccgtcggtctcatcttccactccttcctcctcgtcccttacttctcctggaagtacagtcatcgacgccaccattccaacaccggatccctcgagcgggatgaagtgttcgtccccaagaagaaatccgacatcaagtggtacggaaagtacctaaacaacccgccagaacgcacggtgatgctaaccgtccagttcacgctcggctggcctttgtacttag

SEQ ID NO: 50257 - DNA, 398 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggtaatacggttatccacagaatcaggggataacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50258 - DNA, 342 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaaccggcgtctgggtcaccacgccttcagcgactaccagtggctggacgacaccgtcggcctcatcttccactccttcctcctcgtcccttacttctcctagaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 50259 - DNA, 357 bp, Artificial
  Mutation in BnaC.FAD2.b introduced by TALE nuclease pair BnFAD2_T05
cctctcctccctcaccctctcccttacctcgcctggcccctctactgggcctgcaaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50260 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50261 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatcagacatcaagtggtacggaaagtacctcaacaacccgctaggacgcacggtgatgctaaccgtccagttcacgctcggctggcctttgtacttag

SEQ ID NO: 50262 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggggatgttaacggttcagttcactctcggctggcctttgtacttag

SEQ ID NO: 50263 - DNA, 363 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccttccatttcacgctcggctggcctttgtacttag

SEQ ID NO: 50264 - DNA, 394 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgatggccaccacctgctggggggtcaagccgtgggccttgaccccgtcagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50265 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaaatccgacatcaagtggtacggaaattacctcaacaacccgctaggacgcacggtgattctaaccgtccagtgcacgctcggctggcctttgtacttag

SEQ ID NO: 50266 - DNA, 350 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 50267 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50268 - DNA, 362 bp, Artificial
  Mutation in BnaC.FAD2.b introduced by TALE nuclease pair BnFAD2_T05
cctctcctccctcaccctatctcctacttcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50269 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgctcgtccccaagaagaaatccgacatcaagtggtacggaaagtacctcaacaacccgctaggacgcacggtgatgctaaccgtccagttcacgctcggctggcctttgtacttag

SEQ ID NO: 50270 - DNA, 330 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacctgcgtctgggtcatagcccacgagtgctggacgacaccgtcggcttcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50271 - DNA, 353 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50272 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 50273 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50274 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtagctcaacaacccgctaggacgcacggtgatgctaaccgtccagttcacgctcggctggcctttgtacttag

SEQ ID NO: 50275 - DNA, 450 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgagcggctgttgccggtgctgttccaggcccacggcttgaccccccgctccggggtctggccatcgccagccacgatggcggcaacagccgctggacccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50276 - DNA, 358 bp, Artificial
  Mutation in BnaC.FAD2.b introduced by TALE nuclease pair BnFAD2_T05
cctctcctccctcaccctctcccctacttcgcctggcctctctactgggcctgccagggctgcgtcctaaccggcgtctgggtcatagcccacgagtgcggccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50277 - DNA, 360 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 50278 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 50279 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtgccaccacgccttcagcgactaccagtggctggacgacaccgtgggcctcgtcttccactccttcctcctcgtcccttacttctccttgaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50280 - DNA, 480 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtggcaggcgctggagacggtccagcggctgttgccggtgctgtgccaggcccacggcttgaccccccagcaggtgggggccatcgccagcaataatggtggcaagcaggcgctggggacggtccagaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50281 - DNA, 359 bp, Artificial
  Mutation in BnaC.FAD2.b introduced by TALE nuclease pair BnFAD2_T05
cctctcctccctcacactctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50282 - DNA, 348 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 50283 - DNA, 319 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaccaacccgctaggacgcaaggtgaagctaaccgtcccgttcccgctcggctggcctttgtacttag

SEQ ID NO: 50284 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaattacctcaacaaccctttgggacgcaccgtgatgttaacggttcagttcactctcggctggcctttgtacttag

SEQ ID NO: 50285 - DNA, 471 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctggggggtcaagccgtgggcctggcacagcaccggcaacagcgcaatgacattcttgcaggtatggccaccacctggggggtcaagccgtgggcctggcacagcaccggcaacagccgctggaccgtctccagcgcctgcttgcccaccacgccttcagcgactaccagtggcttgacgacaccgtcggactcatcttccactccttcctccgcgtcccttacttctcctggaagtacagccatcgacgccaccattccaacaccggatccctcgagagggatgaagtgttcgtccccaagaagaaagccgacatcaagtggtacggaaagtacctcaacaacccgctaggacgcacggtgatgctaaccgtccagttcacgctcggctggcctttgtacttag

SEQ ID NO: 50286 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggcccccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50287 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcctctgggtcatcgcccacgaatgcggctggacgaccccgtgggcctcgtcttccactccctcctcctcgtcccttacttctcctggaagtacagccatcgacgccaccattccaacaccggatccctcgagagagatgaagtgttcgtccccaagaagaaatccgacatcaagtggtacggaaagtacctcaacaacccgctgggacgcacggtgatgctaaccgttcagttcactctcggctggcctttgtacttag

SEQ ID NO: 50288 - DNA, 370 bp, Artificial
  Mutation in BnaC.FAD2.b introduced by TALE nuclease pair BnFAD2_T05
ctctcctccctcaccctctctcctacttcgcctggcctctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50289 - DNA, 354 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagcaccacgccttagcgactaccagtggcttgacgacaccgtcggtctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctgtgtacttag

SEQ ID NO: 50290 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaactggcacagcaccggcaacagccgcttgacaacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50291 - DNA, 360 bp, Artificial
  Mutation in BnaC.FAD2.b introduced by TALE nuclease pair BnFAD2_T05
cctctcctccctcaccctctcacttacctcgcctggcccctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctgtgtacttag

SEQ ID NO: 50292 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50293 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50294 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacatcaacaacccgctaggacgcacggtgatgctaaccgtccagttcacgctcggctggcctttgtacttag

SEQ ID NO: 50295 - DNA, 355 bp, Artificial
  Mutation in BnaC.FAD2.b introduced by TALE nuclease pair BnFAD2_T05
cctctcctccctcaccctctctcctacttcgcctagcctctctactgggcctgccagggctgcgtcctaaccggcgtctgggtcatagcccacgagtaccacgccttcagcgaccaccagtggctggacgacgccgtgggcctcgtcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50296 - DNA, 346 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50297 - DNA, 439 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatcgcccacgagtgcggccattgctggcgatggccaccacctgctccggggtcaagccgtgggcctggcacagcaccggcaagcaggcgctggagagaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggcctttgtacttag

SEQ ID NO: 50298 - DNA, 287 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50299 - DNA, 357 bp, Artificial
  Mutation in BnaC.FAD2.b introduced by TALE nuclease pair BnFAD2_T05
gctctcctccctcaccctctcccttacctcgcctggcccctctactgggcctgccaaggctgcgtcctaacgggcctctgggtcatcgcccacgaatgcaccacgccttcagcgaccaccagtggctggacgacaccgtcggcctcatcttccactccttcctcctcgtcccttacttctcctggaagtacagtcatcgacgccaccattacaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50300 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggccgacgccgtgggcctcgtcttccactccttcctcctcgtcccttacttctcctggaagtacggccatcgacgccaccattccaacaccggatccctcgagagagacgaagtgtttgtccccaagaagaagtcagacatcaagtggtacggcaagtacctcaacaaccctttgggacgcaccgtgatgttaaccggtcagttcactctcggctggccgttgtacttat

SEQ ID NO: 50301 - DNA, 392 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaacgaaacccgacaggactataaagataccaggcgtttccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50302 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50303 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50304 - DNA, 435 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcattgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50305 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 50306 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccggccagttcacgctcggctggcctttgtacttag

SEQ ID NO: 50307 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50308 - DNA, 282 bp, Artificial
  Mutation in BnaC.FAD2.b introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgccggctggcctttgtacttag

SEQ ID NO: 50309 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtggtgctacccgtccaattcacgctcggctggcctttgtacttag

SEQ ID NO: 50310 - DNA, 350 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagccctaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50311 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgttggcctcgtcttccactccttcctcctcgtcccctacttctcctggaagtacagccaacgacgccaccattccaacaccggatccctcgagagggatgaagtgttcgtccccaagaagaaagccgacatcaagtggtacggaaagtacctcaacaacccgctaggacgcacggtgatgctagccgtcgagttcacgctcggctggcctttgtacttag

SEQ ID NO: 50312 - DNA, 419 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagctaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 50313 - DNA, 419 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacaccggatccctcgagatggatgaagtgttcgtccccaagaagaaatccgacatcaagtggtacggaaagtacctcaacaacccgctaggacgcacggtgatgctaaccgtgcagttcacgctcggctggcctttgtacttag

SEQ ID NO: 50314 - DNA, 364 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtgcagttcacgctcggctggcctttgtacttag

SEQ ID NO: 50315 - DNA, 359 bp, Artificial
  Mutation in BnaC.FAD2.b introduced by TALE nuclease pair BnFAD2_T05
cctctcctccctcaccctctcccttacctctcctggtccccctactcggcttgccaaggccgcgccctaacggccctctgggtcatcgcctaccaattcccaccacgccttcagcgaccaccagtggctggacgacgccgtgggcctcgtcttccactccttcctcctcgtcccttacttctcctggaagtacggccatcgacgccaccattccaaaaccggatccctcgagagggatgaagtgttcgtccccaagaagaaatccgacatcaagtggtacggatagtccctcaacaccccgcttgggtataaggtgatgctattcgtccatttctctctcggctggcctttgtacttag

SEQ ID NO: 50316 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 50317 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactag

SEQ ID NO: 50318 - DNA, 342 bp, Artificial
  Mutation in BnaC.FAD2.b introduced by TALE nuclease pair BnFAD2_T05
cctctcctccctcaccctctcccttacctcgcctggcctctctactgggcctgccagggctgcgtcctaaccggcgtctgggtcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50319 - DNA, 441 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaagcaggcgctggagacggtccagcggctgttgccggtgctgtgccatggggggtcaagccgtgggcctggcacagcaccggccaccacgccttcagcgaccacaagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 50320 - DNA, 430 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaggcccacggcaacagccgctggaccgtctccagcgcctgcttgccaccattattgctggcgatggccacccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggttatgctaaccgtccagttcacgctcggctggcctttgtacttag

SEQ ID NO: 50321 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 50322 - DNA, 330 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgctggacgacaccgtcggcttcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50323 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50324 - DNA, 358 bp, Artificial
  Mutation in BnaC.FAD2.b introduced by TALE nuclease pair BnFAD2_T05
cctctcctccctcaccctctcccttgcctctccttgccccccttctctgcctcccaactctgcgccctcacgtccctctgggtcatcgtccaccaattccaccccgccttcagcgaccaccagttgctggacgacgccgtaggcctcgtcttccactccttcctcctcgtcccttacttctcctggaagtacagccatcgacgccaccattccaacaccggatccctcgagagggatgaagtgttcgtccccaagaagaaatccgacatcaagtggtgcggaaagtcccccaacaccccgctaggacgcacgggactgctacccctccagcccccgctcggctggcctttgtacttag

SEQ ID NO: 50325 - DNA, 360 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 50326 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatcccacatcaagtggtacggaaagtacctcaacaacccgctaggacgcacggtgatgctaaccgtccagttcacgctctgctggccttagtacttag

SEQ ID NO: 50327 - DNA, 353 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggccgcatggtgatgctaaccggccagtccacgctcggttggcctttgtccgtag

SEQ ID NO: 50328 - DNA, 364 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcggcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcgcggtgatgctaaccgtccagttcacgctcggcttgctgttgtacttag

SEQ ID NO: 50329 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50330 - DNA, 355 bp, Artificial
  Mutation in BnaC.FAD2.b introduced by TALE nuclease pair BnFAD2_T05
cctctcctccctcaccctctcccttacctcgcctggcctctctactgggcctgccaagggtgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50331 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccgagaagaaatccgacatcaagtggtacggaaagtacctcaacaacccgctaggacgcacggtgatgctaaccgtccagttcacgctcggctggcctttgtacttag

SEQ ID NO: 50332 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50333 - DNA, 356 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtgcccacgccttcagcgactaccagtggcttgacgacaccgtcggtctcatcttccactccttcctcctcgtcccttacttctcctggaagtacagccatcgacgccaccattccaacaccggatccctcgagagagatgaagtgttcgtccccaagaagaaatccgacatcaagtggtacggaaagtacctcaacaaccctctaggacgcacggtgatgctaaccgttcagttcacgctcggctggcctttgtacttag

SEQ ID NO: 50334 - DNA, 356 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgagtgaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgcgaaccgtccagttcacgctcggctggcctttgtacttag

SEQ ID NO: 50335 - DNA, 357 bp, Artificial
  Mutation in BnaC.FAD2.b introduced by TALE nuclease pair BnFAD2_T05
ccctcctccctcaccctctctcctacttcgcctggcctctctactgggcctgccaagggtgcgtcctaaccggcgtctgggtcatagcccacgagtgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttgtacttag

SEQ ID NO: 50336 - DNA, 342 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50337 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50338 - DNA, 359 bp, Artificial
  Mutation in BnaC.FAD2.b introduced by TALE nuclease pair BnFAD2_T05
cctctcctccctcaccctgtctcctacttcgcctggcctctctactgggcctgccagggctgcgtcctaaccggcgtctgggtcatagcccacgagtgcgcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50339 - DNA, 319 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgagtgcgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50340 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctctgctggcctttgtacttag

SEQ ID NO: 50341 - DNA, 346 bp, Artificial
  Mutation in BnaC.FAD2.b introduced by TALE nuclease pair BnFAD2_T05
cctctcctccctcaccctttcccttacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacgtcaagtggtacggaaagtacctcaacaacccgctaggacgcacggtgatgctcaccgtccaggtcactctcggctggcctttgtacttag

SEQ ID NO: 50342 - DNA, 357 bp, Artificial
  Mutation in BnaC.FAD2.b introduced by TALE nuclease pair BnFAD2_T05
cctctcctccctcaccctctcccttacctcgcctggcctctctactgggcctgccaagggtgcgtcctaaccggcgtctgggtcatagcccacgaatgccaccacgccttcagcgaccaccagtggctggacgacgccgtgggcctcgtcttccactccttcctcctcgtcccttacttctcctggaagtacagccatcgacgccaccattccaacaccggatccctcgaggggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50343 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50344 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgacaaccagtggctggacgacgccgtgggcctcgtcttccactccttcctcctcgtcccttccttctcctggaagtacagccatcgacgccaccattccaacaccggatccctcgagagggaggaagtgttcgtccccaagaagaaatccgacagcaagtggtacggaaagtacctcaacaaccggctaggacgcagggtgatgcgaaccgtccagttcacgctcggctggcctttgtcctgag

SEQ ID NO: 50345 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgaccccgtgggcctcgtcttccactccttcctcctcgtcccttacctctcccggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50346 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctactggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50347 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 50348 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgtgtcatagcccacgagtgcaccacgccttcagcgactaccagtggcttgacgacaccgtcggtctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50349 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttccttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50350 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcttgcctttgtacttag

SEQ ID NO: 50351 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtcggcctcgtcttccactccttcctcctcgtcacttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50352 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcttggacgcacggtgatgctaaccgtccagttcacgctcggctggcctttgtacttag

SEQ ID NO: 50353 - DNA, 358 bp, Artificial
  Mutation in BnaC.FAD2.b introduced by TALE nuclease pair BnFAD2_T05
cctctcctccctcaccctctcccttacctcgcctggccactctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccggtaggacgcacggtgatgctacccgtccagttcacgctcggctggcctttgtacttag

SEQ ID NO: 50354 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50355 - DNA, 401 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtacgtccccaagaagaaatccgacatcaagtggtacggaaagtacctcaacaacccgctaggtcgcacggtgatgctaaccggccagttctcgctcggctggcctttatacttag

SEQ ID NO: 50356 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagtgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50357 - DNA, 356 bp, Artificial
  Mutation in BnaC.FAD2.b introduced by TALE nuclease pair BnFAD2_T05
ctctcctccctcaccctatcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50358 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctagcacgcacggtgatgctaaccgtccagttcacgctcggctggcctttgtacttag

SEQ ID NO: 50359 - DNA, 358 bp, Artificial
  Mutation in BnaC.FAD2.b introduced by TALE nuclease pair BnFAD2_T05
cctctcctccctcaccctctctcctacttcgcctggcctctctactcggcctgccagggctgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50360 - DNA, 346 bp, Artificial
  Mutation in BnaC.FAD2.b introduced by TALE nuclease pair BnFAD2_T05
cctctcctccctcaccctctcccttacctcgcctggccccgctactgagcctgccaaggctgcgtcctaacgggcctctgggtcatctaccacgccttcagcgaccaccagtggctggacgacgccgtgggtctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatcctcaccgtccagttcacgctcggctggcctttgtacttag

SEQ ID NO: 50361 - DNA, 358 bp, Artificial
  Mutation in BnaC.FAD2.b introduced by TALE nuclease pair BnFAD2_T05
cctctcctccctcaccctctcacttacctcgcctggcccctctactgggcctgccaagggtgcgtcctaaccggcgtctgggtcatagcccacgagtgccaccacgccttcagcgactaccagtggcttgacgacgccgtgggcctcgtcttccactccttcctcctcgtcccttacttctcctggaagtacagccatcgacgccaccattccaacaccggatccctcgagagggatgaagtgttcgtccacaagaagaaatccgacatcaagtggtacggaaagtacctcaacaacccgctaggacgcacggtgatgctaaccgtccagttcacgctcggctggcctttgtacttag

SEQ ID NO: 50362 - DNA, 331 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcagcgactaccagtggcttgacgacaccgtcggtctcatcttccactccttcctcctcgtcccttacttctcctggaagtacagccatcgactccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtactcag

SEQ ID NO: 50363 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagtgcacgctcggctggcctttgtacttag

SEQ ID NO: 50364 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaacccgctaggacgcacggtgatgctaaccgtccagttcacgctcggctggcctttgtacttag

SEQ ID NO: 50365 - DNA, 435 bp, Artificial
  Mutation in BnaC.FAD2.b introduced by TALE nuclease pair BnFAD2_T05
cctctcctccctcaccctctcccttacctcgcctggacccactactgggcctgccaaggctgcgtcctaacgggcctctgggtcattgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcgcggtgatgctagccgtccagtgcacgctcggctggcctttgtacttag

SEQ ID NO: 50366 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttat

SEQ ID NO: 50367 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50368 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacaccggatcccgcgagagggatgaagtgttcgtccccaagaagaaatccgacatcaagtggtacggcaagtacctcaacaaccctgtgggacgcaccgtgatgttaacggttcagttcactctcggctggcctttgtacttag

SEQ ID NO: 50369 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgtcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50370 - DNA, 355 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50371 - DNA, 358 bp, Artificial
  Mutation in BnaC.FAD2.b introduced by TALE nuclease pair BnFAD2_T05
cctctcctccctcaccctctcccttacctcgcctggcccctctactgagcctgcccaggctgcgtcctaacgggcctctagtccatcgcccacgactgcccccccgccttcagcgaccaccagtggcgggacgacgccgtgggcctcgtcttccactccttcctcctcgtcccttacttctcctggaagtacagccatcgacgccaccattccaacaccggatccctcgagagggatgaagtgttcgtccccaagaagaaacccgacatcaagtggtaaggaaagtacctcaacaacccgccagaacgctcggtgatgctcaccgcccagttcacgctcggctggcctttgtacttag

SEQ ID NO: 50372 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccgccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 50373 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgtgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50374 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50375 - DNA, 447 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggctagccacgatggcggctagccaccgtggtggccatcgccagccacgatggcggcaagcaggcgctggagcctggcacagcaccggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50376 - DNA, 371 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgcctgcttgccaccgccatcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50377 - DNA, 443 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcctcaagccgtgggcctggtccagcggctgttgccaccgccattgctggcgatggccaccacctgctggggggtcaagccgtgtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50378 - DNA, 353 bp, Artificial
  Mutation in BnaC.FAD2.b introduced by TALE nuclease pair BnFAD2_T05
cctctcctccatcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgtcaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50379 - DNA, 354 bp, Artificial
  Mutation in BnaC.FAD2.b introduced by TALE nuclease pair BnFAD2_T05
cctctcctccctcaccctctcccttacctcgcctgtcccctctactcggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttgactctcggctggcctttgtacttag

SEQ ID NO: 50380 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50381 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctagtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 50382 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctggacgacgccgtgggcctcgtcttccactccttcctcctcgtcccttacttctcctggaagtacagccatcgacgccaccattccaacaccggatccctcgagagggattaagtgttcgtccccaagaagaaatccgacatcaagtggtacggaaagtacctcaacaacccgctaggacgcacggtgatgctaaccgtccagttcactctcggctggcctttgtacttag

SEQ ID NO: 50383 - DNA, 319 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50384 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatctagtggtacggaaagtacctcaacaacccgctaggacgcacggtgatgctaaccgtccagttcacgctcggctggcctttgtacttag

SEQ ID NO: 50385 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaacccgctaggacgcacggtgatgctaaccgtccagttcacgctcggctggcctttgtacttag

SEQ ID NO: 50386 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggactacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50387 - DNA, 358 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50388 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggggatgctaaccgtccagttcacgctcggctggcctttgtacttag

SEQ ID NO: 50389 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50390 - DNA, 353 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgcaccacgccttcagcgaccaccagtggctggacgacgccgtgggcctcgtcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50391 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50392 - DNA, 358 bp, Artificial
  Mutation in BnaC.FAD2.b introduced by TALE nuclease pair BnFAD2_T05
cctctcctccctcaccctctcccctacctcgtctggccactcgactcggcttgccaaggctgcgtcctaacgagcgtctgggtcatggcccacgacttctgcctccacatcagcgaccaccagtggctggacgacgccgtgggcctcatcttccactccttcctcctcgtcccttacttctcctggaagtacagccatcgacgccaccattccaacaccggatccctcgagagggatgaagtgttcgtccccaagaagaaatccgacatcaagtggtctggcaagtcccccaccacctcggttggatgcaaggtgctgctaaccgtcccgctcccgctaggctggcctttgtacttag

SEQ ID NO: 50393 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaactacctcaacaaccctctaagacgcacgttgatgctaaccgtccagttcacgctcggctggcctttgtgcttag

SEQ ID NO: 50394 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaggtgttcgtccccaagaagaaatccgacatcaagtggtacggaaagtacctcaacaacccgctaggacgcacggtgatgctaaccgtccagttcacgctcggctggcctttgtacttag

SEQ ID NO: 50395 - DNA, 358 bp, Artificial
  Mutation in BnaC.FAD2.b introduced by TALE nuclease pair BnFAD2_T05
cctctcctccctcaccctctcccttaccccgtgtggcccccctactggtcctcccaaggctgcgtcctaacggccctctgggtcatcgcccacgaatgacaccacgcctccagcgcccaccagtggctggacgacgccgaaggcctcgtcttctacaccttcctccccgtcccttacttctcctggaaggacaggcatcgacgccaccattccaacaccggatccctcgagagggatgaagtgttcgtccccaagaagaaaaccgacatcaagtggcacggaaagtacctcaacaccccgctaggacgcacggggatgctaatcctccagttcacgctcggctggcctttgtacttag

SEQ ID NO: 50396 - DNA, 347 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccaactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50397 - DNA, 354 bp, Artificial
  Mutation in BnaC.FAD2.b introduced by TALE nuclease pair BnFAD2_T05
cctctcctcctccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50398 - DNA, 360 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcaccacgccttcagcgactaccagtggctttacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctctaggacgcacggtgatgctaaccgtccagttcacgctcggctggcctttgtacttag

SEQ ID NO: 50399 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacagcccgctaggacgcacggtgatgctaaccgtccagttcacgctcggctggcctttgtacttag

SEQ ID NO: 50400 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtaatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50401 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50402 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcataacccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50403 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50404 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgaccacgccttcagcgactaccagttgctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50405 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctagtacgcacggtgatgctaaccgtccagttcacgctcggctggcctttgtacttag

SEQ ID NO: 50406 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 50407 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggcctcatcttccactccttcctcctcgtcccttacttctcctggaagtacagccatcgacgccaccattccaacaccggatccctcgagagggaggaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50408 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacaaccatcgacgccgccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50409 - DNA, 364 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtccctcacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50410 - DNA, 280 bp, Artificial
  Mutation in BnaC.FAD2.b introduced by TALE nuclease pair BnFAD2_T05
cctctcctccctcaccctctctcctacttcgccttccctctctactgggcctgccaagggtgcgccctaaccggccactccttcctcctcgtcccttacttctcctggaagtacagccgtcgacgccaccattccaacaccggatccctcgagagggatgaagtgttcgtccccaagaagaaatccgacatcaagtggtacggaaagtacctcaacgacccgctagtacgcacggtgatgctaaccgtccagttcccgctcggctggcctttgtacttag

SEQ ID NO: 50411 - DNA, 353 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50412 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggcttgacgacaccgtcggtcccatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcatttgtacttag

SEQ ID NO: 50413 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtgttacggaaagtacctcaacaacccgctaggacgcacggtgatgctaaccgtccagttcacgctcggctggcctttgtacttag

SEQ ID NO: 50414 - DNA, 358 bp, Artificial
  Mutation in BnaC.FAD2.b introduced by TALE nuclease pair BnFAD2_T05
cctctcctccctcaccctctcccttacctcgcctggcccctttactcggccagccaaggctgcgtcctaacggccctctgggtcatcgcccacgaatgccaccacgccttcagcgaccaccagtggctggacgacgccgtgcgcctcgtcttccacccctgcctcctcgtcccttacttctcctggaagtacagccatcgacgccaccattccaacaccggatccctcgagagggatgaagtgttcgtccccaagaagaaatccgacatcaagtggtacggaaattaccccaacacgccgctagggcgcaaggtgctgctaaccgtccagctcccgctcggctggcctttgtacttag

SEQ ID NO: 50415 - DNA, 358 bp, Artificial
  Mutation in BnaC.FAD2.b introduced by TALE nuclease pair BnFAD2_T05
cctctcctccctcaccctctcccttacctctcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50416 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggcgggcctttgtacttag

SEQ ID NO: 50417 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctgtgtacttag

SEQ ID NO: 50418 - DNA, 364 bp, Artificial
  Mutation in BnaC.FAD2.b introduced by TALE nuclease pair BnFAD2_T05
cctctcctccctcaccctctgccttacctcgcctggcccctctactgggcctgccaaggctgcgtcctaacgagcctctgggtcatcgcccacgaatgcggcggccaccacgccttcagcgaccaccagtggctggacgacgccgagggccccgccctccactccttcctcctcgtcccttacttctcctggaagtacagccatcgacgccaccattccaacaccggatccctcgagagggatgaagtgttcgtccccaagaagaagccagacatcaagtggtacggcgagtacctcaacatccctttgggacgcactgtgaggttaacggttcagttcactcgcgcccggcctgagtacctag

SEQ ID NO: 50419 - DNA, 364 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 50420 - DNA, 403 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagcaggtggtggccatcgccagcaataatggtggcaagcaggcgctggagaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50421 - DNA, 401 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggctgttgccggtgctgtgccaggcccacggcttgaccccggacaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50422 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggcctcgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggggatgctacccgtccagttcacgctcggctggcctttgtacttag

SEQ ID NO: 50423 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50424 - DNA, 408 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacaggcctctgggtcatcgcccacgaatattggtggcaagcaggcgctggagacggtgcaggcgctgttgccggtgctgtgccaccaccccttcagcgaccaccagtggctggacgacgccgttggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctgccttgtacttag

SEQ ID NO: 50425 - DNA, 345 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50426 - DNA, 333 bp, Artificial
  Mutation in BnaC.FAD2.b introduced by TALE nuclease pair BnFAD2_T05
cctctcctccctcaccctctaacttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggcgggcctttgtacttag

SEQ ID NO: 50427 - DNA, 357 bp, Artificial
  Mutation in BnaC.FAD2.b introduced by TALE nuclease pair BnFAD2_T05
ctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50428 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50429 - DNA, 347 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccaactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 50430 - DNA, 428 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccatcgccagcaatattggtggcaagcgggcgctggagacggtgcaggcgctgttgccggtgctgtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50431 - DNA, 432 bp, Artificial
  Mutation in BnaC.FAD2.b introduced by TALE nuclease pair BnFAD2_T05
cctctcctccctcaccctctcccttacctcgcatggcccctctactgggcctgccaaggctgcgccctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctccttgtcccttccttctcctggaagtacagccatcgacgccaccattccaacaccggatccctcgagagggatgaagtgttcgtccccaagaagaaatccgacatcaagtggtacggaaagtaccgcagcaaccctctggggcgtacggtgatgctccccgtccagttcaccctcggctggcctttgtacttag

SEQ ID NO: 50432 - DNA, 355 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtaccacgccttcagcgaccaccagtggctggacgacgccgtgggcctcgtcttccactccttcctcctcgtcccttacttctcctggaagtacagccatcgactccaccattccaacaccgggtccctcgagagggatgaagtgttcgtccccaagaagaaatccgacatcaagtggtacggaaagtacctcaacaacccgctagaacgcacggtgaggctacccgtccaggtcatgctcggctggcctttgtacttag

SEQ ID NO: 50433 - DNA, 418 bp, Artificial
  Mutation in BnaC.FAD2.b introduced by TALE nuclease pair BnFAD2_T05
cctctcctccctcaccctctcccttacctctcctgtcccctctactgggcctgccaaggctgcgtccaaacgggccggcaggcgctccattgcccagtcggcagcgacatccttcggcgcgattttgccggttactgcgctgtaccaaatgcgggacaacggccacgccttcagcgccccccagtggctggacgacgccgtgggcctcgtcttccactccttcctcctcgtcccttacttctcctggaagtacagccatcgacgccccattccaacaccggatccctcgagagggatgaagtgttcgtccccaagaagaaatccgacatcaagtggtacggaaagtccctcaacaccccgctaggacgcacggtgctgctacccgtccagttcacgctcggctggcctttgtacttag

SEQ ID NO: 50434 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgattttaacggttcagttcactctcggctggcctttgtacttag

SEQ ID NO: 50435 - DNA, 283 bp, Artificial
  Mutation in BnaC.FAD2.b introduced by TALE nuclease pair BnFAD2_T05
cctctcctccctcaccctctcccttaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 50436 - DNA, 353 bp, Artificial
  Mutation in BnaC.FAD2.b introduced by TALE nuclease pair BnFAD2_T05
cctctcctccctcaccctctcccttacctcgcctggcccctctacttggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50437 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaaccggcgtctgggtcatagcccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 50438 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaacgggcctctgggtcatagcccacgagtgcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50439 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50440 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcgcggtgatgctaaccgtccagctcacgctcggctggcctttgtacttag

SEQ ID NO: 50441 - DNA, 346 bp, Artificial
  Mutation in BnaC.FAD2.b introduced by TALE nuclease pair BnFAD2_T05
cctctcctccctcaccctctaccttacctcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50442 - DNA, 364 bp, Artificial
  Mutation in BnaC.FAD2.b introduced by TALE nuclease pair BnFAD2_T05
cctctcctccctaaccctctctcctacttcgcctggcctctctactgggcctgccaagggtgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50443 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgccaggacgcacggtgatgctaaccgtccagttcacgctcggctggcctttgtacttag

SEQ ID NO: 50444 - DNA, 353 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttggtacttag

SEQ ID NO: 50445 - DNA, 358 bp, Artificial
  Mutation in BnaC.FAD2.b introduced by TALE nuclease pair BnFAD2_T05
cctctcctccctcaccctctcccttacctcgcctggcccctctcctgggcctgccaaggctgcgtcctaacgggcctctgggtcatcgcccacgaatgccaccacgccttcagcgaccaccagtggctggacgacgccgtgtgcctcgtctaccactccttcctcctcgtcccttacttctcctggaagtacaggcatcgacgccaccattccaacaccggatccctcgagagtgatgaagtgttcgtccccaagaagaaatccgacatcaagtggtacggaaagtacctaaacaacccgctaggacgcacggtgaggcaaaccgtccaggtcacgctcggatggcctttgtacctag

SEQ ID NO: 50446 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcctctcgccctgatccggcgttggccgcgttgaccaacgaccacctcgtcgccttggcctgcctcggcgggccaccacgccttcagcgaccaccagtggctggacgacgccgtgggcctcgtcttccactccttcctcctcgtcccttacttctcctggaagtacagccatcgacgcctccattccaacaccggatccctcgagagggatgaagtgttcgtccccaagaagaaatccgacatcaagtggtacggaaagtacctcaacaacccgctaggacgcacggtgatgctaaccttccagttcacgatcggctggcctttgtacttag

SEQ ID NO: 50447 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50448 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaggaagaaatccgacatcaagtggtacggaaagtacctcaacaaccctctaggacgcacggtgatgctaaccgtccagttcacgctcggctggcctttgtacttag

SEQ ID NO: 50449 - DNA, 358 bp, Artificial
  Mutation in BnaC.FAD2.b introduced by TALE nuclease pair BnFAD2_T05
cctctcctccctcaccctctcccttacctcgcctggcccctctactgggcctggcaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50450 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 50451 - DNA, 357 bp, Artificial
  Mutation in BnaC.FAD2.b introduced by TALE nuclease pair BnFAD2_T05
cctctcctccctcaccctctcccttacctcgcctggcccctccactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50452 - DNA, 356 bp, Artificial
  Mutation in BnaC.FAD2.b introduced by TALE nuclease pair BnFAD2_T05
cctctcctccctcacccctctctcctacttcgcctggcctctctactgggcctgccagggctgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50453 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaataacccgctaggacgcacggtgatgctaaccgtccagttcacgctcggctggcctttgtacttag

SEQ ID NO: 50454 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50455 - DNA, 410 bp, Artificial
  Mutation in BnaC.FAD2.b introduced by TALE nuclease pair BnFAD2_T05
cctctcctccctcaccctctcccttacctcgcctagcccctctactgggcctgccaaggctgcgtcctaacgggcctctgggtcatcgcccacgaatattggtggcaagcaggcgctggagacggtgcaggcgctgttgccggtgctgtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50456 - DNA, 359 bp, Artificial
  Mutation in BnaC.FAD2.b introduced by TALE nuclease pair BnFAD2_T05
cctctcctccctcaccctctctcctacttctcctggcctctctactgtgcctgccagggctgcgtcctaaccggcgtctgggtcatagcccacgagtgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50457 - DNA, 358 bp, Artificial
  Mutation in BnaC.FAD2.b introduced by TALE nuclease pair BnFAD2_T05
cttctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcatcgtcccttacttctcctggaagtacagccatcgacgccaccattccaacaccggatccctagagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50458 - DNA, 438 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcaacgatgttacgcagcagggcagtcgccctaaaacaaagttaaacattatgagggaagcggtgatcgccgaagtatcgactaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgcgaaccgtccagttcacgctcggctggcctttgtacttag

SEQ ID NO: 50459 - DNA, 401 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtactaacgggcctctgggtcatcgcccacgaatgcggctgttgccggtgctgtgccaggcccacggcttgacccctgacaccacgccttcagccaccaccaatggctggacgacaccgtgggcctcgtcttccactccttcctcctcgtcccttacttctcctggaagtacagccatcgacgccaccattccaacaccggatccctcgagagggatgaagtgttcgtcccaaagaagaaatccgacatcaagtggtacggaaagtacctcaacaacccgctaggacgcacggtgaggctaaccgtccagttcacgctcggctggcctttgtacttag

SEQ ID NO: 50460 - DNA, 357 bp, Artificial
  Mutation in BnaC.FAD2.b introduced by TALE nuclease pair BnFAD2_T05
cctctcctcccccaccctctcccttacctcgcctggcccctctactgggcctgccaaggctgcgtcctaacgggcctctgggtaatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50461 - DNA, 354 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50462 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgttaacggttcagttcactctcggctggcctttgtacttag

SEQ ID NO: 50463 - DNA, 340 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaaccggcgtctgggtcatagcccacgagtgctaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50464 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacagcccgctaggacgcgcggtgatgctaaccgtccaggtcccgctcggctggcctttgtacttag

SEQ ID NO: 50465 - DNA, 450 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagcggctgttgccggtgctgtgccaggcccacggcttgaccccccgctccggggtctggccatcgccagccacgatggcggcaacagccgctggacccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50466 - DNA, 348 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccctaagaagaaatccgacatcaagtggtacggaaagtacctcaacaacccgctaggacgcacggtgatgctaaccgtccagttcacgctcggctggcctttgtacttag

SEQ ID NO: 50467 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtccgacatcaagtggtacggaaagtacctcaacaacccgctaggacgcacggtgatgctaaccgtccagttcacgctcggctggcctttgtacttag

SEQ ID NO: 50468 - DNA, 357 bp, Artificial
  Mutation in BnaC.FAD2.b introduced by TALE nuclease pair BnFAD2_T05
cctctctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50469 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgaccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccactaggacgcacggtgatgctaaccgtccagttcacgctcggctggcctttgtacttag

SEQ ID NO: 50470 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgacttag

SEQ ID NO: 50471 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50472 - DNA, 354 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgacaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50473 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccgttgtacttag

SEQ ID NO: 50474 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcccacgccttcagcgactaccagtggctggacgacaccgtgggcctcgtcttccactccttcctcctcgtcccttacttctcctggaagtacagccatctacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50475 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggccggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 50476 - DNA, 394 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctcctggaagtacagccatcgacgccaccattccaataccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50477 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacagaaagtacctcaacaacccgctaggacgcacggtgatgctaaccgtccagttcacgctcggctggcctttgtacttag

SEQ ID NO: 50478 - DNA, 355 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50479 - DNA, 432 bp, Artificial
  Mutation in BnaC.FAD2.b introduced by TALE nuclease pair BnFAD2_T05
cctctcctccctcaccctctcccttacctcgcctggcccctctactgggcctgccaaggctgcgcccaaacgggcctctgggtcatcgcctacgaatgcggcctctcgccctgatccggcgttggccgcgttgaccaacgaccacctcctcgccttggcctgcctcggcgggcccccacgccttcagccaccaccagtggctggacgacgccgtgggcctcgtcttcccctccttcctcctcgtcccttacttctcctggaagtacagccatcgacgccaccattccaacaccggatccctcgagagggatgaagtgttcgtccccaagaagaaatctgacatcaagtggtacggaaagtacctcaacaacccgctaggacgcacggtgatgctaaccctccagttcacgctcggctggcctttgtacttag

SEQ ID NO: 50480 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactcgcggctggcctttgtacttag

SEQ ID NO: 50481 - DNA, 328 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggcgtctgggtcatagcccacgagtgcgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50482 - DNA, 345 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagttgtacggaaagtacctcaacaaccctttgggacgcaccgtgatgttaacggttcagttcactctcggctggcctttgtacttag

SEQ ID NO: 50483 - DNA, 364 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggccgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50484 - DNA, 346 bp, Artificial
  Mutation in BnaC.FAD2.b introduced by TALE nuclease pair BnFAD2_T05
cctctcctccctcaccctctcccttacctcgcctggcccctctactgggcctgccaagggtgcgtcctaacgggcctctgggtcatcgcccacgccttcagcgaccaccagtggctggacgacgccgtgggcctcgtcttccactccttcctcctcgtcccttacttctcctggaagtacagccatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50485 - DNA, 424 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcccggtgatgctaaccgtccagttcacgctcggctggcctttgtacttag

SEQ ID NO: 50486 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50487 - DNA, 359 bp, Artificial
  Mutation in BnaC.FAD2.b introduced by TALE nuclease pair BnFAD2_T05
cctctcctccctcaccctttcacttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50488 - DNA, 425 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggccaccgccattgctggcgatgagcgttcaccgacaaacaacagataaaacgaaaggctcagtcttaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccttagtacttag

SEQ ID NO: 50489 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatctacgccaccattccaacaccggatccctcgagagggatgaagtgttcgtccccaagaagaaatctgacatcaagtggtacggaaagtacctcaacaacccgctaggacgcacggtgatgctaaccgtccagttcacgctcggctggcctttgtacttag

SEQ ID NO: 50490 - DNA, 280 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaaccggccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50491 - DNA, 353 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtcaagttcacgctcggctggcctttgtacttag

SEQ ID NO: 50492 - DNA, 357 bp, Artificial
  Mutation in BnaC.FAD2.b introduced by TALE nuclease pair BnFAD2_T05
cctctcctccctcaccctctcccttacctcgcctggcccctccactgggcctgccaaggctgcgtcctaacgggcctctgggtcatcgcccacgaatgaaccacgccttcagcgaccaccagtggctggacgccgccgtgggcctcgtcttccactccttcctcctcgtcccttacttctcctggaagtacagccatcgacgccaccattccaacaccggagccctcgagagggatgaagcgttcgcccccaagaagaagtcagacatcaactggtacggcaagtacctcagcaaccctttggaacgcaccgtgatgttaacggttcagttcactctccgccggcctttgtacttag

SEQ ID NO: 50493 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 50494 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacaggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50495 - DNA, 401 bp, Artificial
  Mutation in BnaC.FAD2.b introduced by TALE nuclease pair BnFAD2_T05
ctctcctccctcaccctctcccttacctcgcctggcccctctactgcgcctgccaaggctgcgtcctaacgggcgtctgggtcatagcccacgagtgcggcttcccctggagagagcgagattctccgcgctgtagaagtcacaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 50496 - DNA, 356 bp, Artificial
  Mutation in BnaC.FAD2.b introduced by TALE nuclease pair BnFAD2_T05
cctctcctccctcaccctctcccttacctcggctggcctctctactgggcctgccaagggtgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50497 - DNA, 357 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgcccgcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 50498 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgcgcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50499 - DNA, 394 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50500 - DNA, 353 bp, Artificial
  Mutation in BnaC.FAD2.b introduced by TALE nuclease pair BnFAD2_T05
cctctcctccctcaccctctcccttacctcttctgccccctctactctgcctgccaaggctgagtcctaaaggccctctgggacatcgcccacgcaccactccttcagagaccaccagtggctggacgacgccgtgggcctcgtcttccactccttcctcctcgtcccttacttctcctggaagcacagtcatcgacgccaccattccaacaccggatccctcgagagggatgaagtgttcgtccccaagaagaaatccgacatcaagtggcacggatagtccctgaacgagccgctaggatgtacggtgatgctaaccgtccagttcacgctcggctggcctttgtacttag

SEQ ID NO: 50501 - DNA, 419 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50502 - DNA, 359 bp, Artificial
  Mutation in BnaC.FAD2.b introduced by TALE nuclease pair BnFAD2_T05
cctctcctccctcaccctatcccttacctcgcctggcccctctactgggcctgccaaggctgcgtcctaacgggcctctgggtcatcgcccacgaatgcggaccacgccttcagcgaccaccagtggctggacgacgccgtgggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50503 - DNA, 392 bp, Artificial
  Mutation in BnaC.FAD2.b introduced by TALE nuclease pair BnFAD2_T05
cctctcctccctcaccctctcccttacctcgcctggcctctctactgggcctgccaagggtgcgtcctaaccggcgtctgggtcatagcccacgagtgcttctagctgataaattcatgccggagagggtggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50504 - DNA, 433 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcggcaaacaaaccaccgctggtagcggtggtttttttgtttgcaagcagcagattacgcgcagaaaaaaaggacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50505 - DNA, 333 bp, Artificial
  Mutation in BnaC.FAD2.b introduced by TALE nuclease pair BnFAD2_T05
cctctcctccctcaccctttcccttacctcgcctggcaactctcctaggcctgccaaggctgcgtcctacagggcctctgggtcatcgcccacgaatgtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50506 - DNA, 358 bp, Artificial
  Mutation in BnaC.FAD2.b introduced by TALE nuclease pair BnFAD2_T05
cctctcctccctcaccctctcccttacctcgcctggcacctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccttccatttcacgcgcggctggcctttgtacttag

SEQ ID NO: 50507 - DNA, 355 bp, Artificial
  Mutation in BnaC.FAD2.b introduced by TALE nuclease pair BnFAD2_T05
cctcccctccctcaccctctctcctacttcgcctggcctctctactgggcctgccaagggtgcgtcctaaccggcgtctgggtcatagcccacggccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50508 - DNA, 358 bp, Artificial
  Mutation in BnaC.FAD2.b introduced by TALE nuclease pair BnFAD2_T05
cctctcctccctcaccctctcccttacctcgcctggcacctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtagctcaacaaccctctaggacgcacggtgatgcttaccgtccagttcacgctcggctggcctgagtacttag

SEQ ID NO: 50509 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaaaacccgctaggacgcacggtgatgctaaccgtccagttcacgctcggctggcctttgtacttag

SEQ ID NO: 50510 - DNA, 359 bp, Artificial
  Mutation in BnaC.FAD2.b introduced by TALE nuclease pair BnFAD2_T05
cctctcctccctcaccctctctcctacttcgcctggcctctccactgggcctgccagggctgcgtcctaaccggcgtctgggtcatagcccacgagtgcggaccacgccttcagcgactaccagtggctggacgacaccgtcggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50511 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgctcggctggcctttgtacttag

SEQ ID NO: 50512 - DNA, 283 bp, Artificial
  Mutation in BnaC.FAD2.b introduced by TALE nuclease pair BnFAD2_T05
cctctcctccctcaccctctcccttaccacgccttcagcgaccaccagtggctggacgactccgtgggcctcgtcttccactccttcctcctcgtcccttacttctcctggaagtacagccatcgacgccaccattccaacaccggctccctctagagggatgaagtgctcgtccccaagaagacatccgacatcaagtggtacggaaagtacctcaacaaccctttgggacgcaccgtgatgttaacggttcagttcactctcggctggcctttgtacttag

SEQ ID NO: 50513 - DNA, 394 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgatggccaccacctgctggggggtcaagccgtgggccttgaccccgtcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50514 - DNA, 359 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcccaccacgccttcagcgaccaccagtggctggacgacgccgtgggcctcgtcttccactccttcctcctcgtcccttacttctcctggaagtacagccaacgacgccaccattccaacaccggatccctcgagagggatgaagtgttcgtccccaagaagaaatccgacatcaagttgtacggaaagtacctcaacaacccgctaggacgcacggtgatgctaaccgtccagttcacgctcggctggcctttgtacttag

SEQ ID NO: 50515 - DNA, 358 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50516 - DNA, 435 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtaggcctcgtcttccactccttcctccccgtcccttacttcgccgggaagtccagccatcgacgcctccattccaacaccggatccctcgagagggatgaagggttcgtccccaagaagaaatccgacatcaagtggtacggaaagtacctcaacaccccgctaggacgcacggtgatgctacccgtccagttcacgctcgcctggcctttgtacttag

SEQ ID NO: 50517 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaccgggcctctgggtcatcgcccacgaatgaaccacgccttcagcgaccaccagtggctggacgaccccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtagctcaacaagccggtgggacgcaccgtgatgttaactgttcggttcacgctcggctggcctgtgtacttag

SEQ ID NO: 50518 - DNA, 349 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggatccctcgagagggatgaagtgttcgtccccaagaagaaatccgacatcaagtggtacggaaagtacctcaacaacccgctaggacgcacggtgatgctaaccctccagttcacgctcggctggcctttgtacttag

SEQ ID NO: 50519 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccggccagttcacgctcggctggccgatgtacttag

SEQ ID NO: 50520 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggccagtgtacttag

SEQ ID NO: 50521 - DNA, 357 bp, Artificial
  Mutation in BnaC.FAD2.b introduced by TALE nuclease pair BnFAD2_T05
cctctcctccctcaccctatctcctacttcgcctggcctctctactgggcctgccagggctgcgtcctaaccggcgtctgggtcatagcccacgagtgccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggcctttgtacttag

SEQ ID NO: 50522 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtacccaagaagaaatccgacatcaagtggtacggaaagtacctcaacaacccgctaggacgcacggtgatgctaaccgtccagttcacgctcggctggcctttgtacttag

SEQ ID NO: 50523 - DNA, 359 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50524 - DNA, 363 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggccccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50525 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50526 - DNA, 363 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50527 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaaggacagccatcgacgccaccattccaacaccggatccctcgagagggatgaagtgttcgtccccaagaagaaatccgacatcaagtggtacggaaaggacctcaacaacccgctaggacgcacggtgatgctaacgtttcagttcaccctcgggtggcctttgtacttag

SEQ ID NO: 50528 - DNA, 357 bp, Artificial
  Mutation in BnaC.FAD2.b introduced by TALE nuclease pair BnFAD2_T05
cctctcctccctcaccatctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50529 - DNA, 424 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcggtatcagaggtagttggcgtcatcgagcgccatctcgaaccgacgttgctggccgtacatttgtacaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgttcggctggcctttgtacttag

SEQ ID NO: 50530 - DNA, 355 bp, Artificial
  Mutation in BnaC.FAD2.b introduced by TALE nuclease pair BnFAD2_T05
cctctcctccctcaccctctcccttacctcgcctggcacctctactgggcctgccaaggctgcgtcctaacgggcctctgggtcatcgcccacggccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50531 - DNA, 349 bp, Artificial
  Mutation in BnaC.FAD2.b introduced by TALE nuclease pair BnFAD2_T05
cctctcctccctcaccctctcccttacctcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50532 - DNA, 358 bp, Artificial
  Mutation in BnaC.FAD2.b introduced by TALE nuclease pair BnFAD2_T05
cctctcctccctcaccctctcccttacctcgcctggcacctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50533 - DNA, 394 bp, Artificial
  Mutation in BnaC.FAD2.b introduced by TALE nuclease pair BnFAD2_T05
cctctcctccctcaccctctcccttacctcgcctggcccctctactgggcctgccaaggctgcgccctaaccgccgcctgggtcatagcccaaaagcattgctcatcaatttgttgcaacgaacaggtcactatccaccacgccttcagcgactaccagtggcttgacgacaccgtcggtctcatcttccactccttcctcctcgtcccttacttctcctggaagtacagccatcgacgccaccattccaacaccggatccctcgagagagatgaagtgttcgtccccaagaagaaatccgacatcaagtggtacggaaagtacctcaacaacccgctaggacgcacggtgatgctaaccgtccagttcacgctcggctggcctatgtacttag

SEQ ID NO: 50534 - DNA, 358 bp, Artificial
  Mutation in BnaC.FAD2.b introduced by TALE nuclease pair BnFAD2_T05
cctctccccctcaccctctcccttacctcgcctggcccctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50535 - DNA, 357 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 50536 - DNA, 435 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcacgctcggctggcctttgtacttag

SEQ ID NO: 50537 - DNA, 363 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50538 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagctatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 50539 - DNA, 463 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgctgcgttaagccaacacccggcagcgttagggaccgtcgctgtcaagtatcaggacattttttctgcgcgtaatctgctgcttgcaaacaaaaaaaccaccgctggaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50540 - DNA, 363 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcggggccaccacgccttcagcgaccaccagtggcttgacgacaccgtcggtctcatcttccactccttcctcctcgtcccttacttctcctggaagtacagccatcgacgccaccattccaacactggctccctcgagagggatgaagtgttcgtccccaagaagaaatccgacatcaagtggtacggaaagtacctaaacaacccgctaggacgcacggtgatgctaaccgtccagttcacgctcggctggcctttgtacttag

SEQ ID NO: 50541 - DNA, 358 bp, Artificial
  Mutation in BnaC.FAD2.b introduced by TALE nuclease pair BnFAD2_T05
cctctcctccctcaccctctcccttacctcgcctggccccactactgggcctgccaaggctgcgtcctaacgggcctctgggtcatcgcccacgaatgccaccaccccttcagcgaccaccagtggctggacgacgccgtaggcctcgtcttccactcctccctcctcgtcccttacttctcctggaagtacagccatcgacgccaccatgccaacaccggatccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50542 - DNA, 419 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggccggcaggcgctccattgcccagtcggcagcgacatccttcggcgcgattttgccggttactgcgctgtaccaaatgcgggacaacggccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50543 - DNA, 418 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgctggcgatggccaccacctgctggggggtcaagccgtggggtcaagccgtgggcctggcacagcaccggcaacagcgactaccagtggctggacgacaccgtcggcctcatcttccactccttcctccttgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50544 - DNA, 364 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggttatcgcccacgaatgcggcggccaccacgccttcagcgaccaccagtggctggacgacgccgtgggcctcgtcttccactccttcctcctcgtcccttacttctcctggaagtacagtcatcgacgccaccattacaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50545 - DNA, 435 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcattgcccacgaatgccaggcccacggcttgaccccggagcaggtggtggccatcgccagccacgatggcggcaagcaggcgctggagacggccaccacgccttcagcgaccaccagtggctggacgacgccgtgggcctcgtcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50546 - DNA, 355 bp, Artificial
  Mutation in BnaC.FAD2.b introduced by TALE nuclease pair BnFAD2_T05
cctctcctccctcaccctctctcctaccccgcctggcttctttactgggcttgccaagggcgcgtcctaaccggcgtctgggtcatagcccacggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatcccacatcaagtgatccggaaagtaccccaacaacccgcaagggcgcacggtaatgctacccctcccgttcactctcggctggcctttgtacttag

SEQ ID NO: 50547 - DNA, 364 bp, Artificial
  Mutation in BnaC.FAD2.b introduced by TALE nuclease pair BnFAD2_T05
cctctcctccctcaccctctcacttacctcgcctggcccctctactgggcctgccaaggctgcgtcctaacgggcctctgggtcatcgcccacgaatgcggcgaccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50548 - DNA, 360 bp, Artificial
  Mutation in BnaC.FAD2.b introduced by TALE nuclease pair BnFAD2_T05
cctctcctccctcaccctctcccttacctcgcctggcacctctactgggcctgccaaggctgcgtcctcacgggcctctgggtcatcgcccacgaatgcgcaccccgccttcagcgaccacccgtggctggacgacggcgtgggcctcgtcttccactccttcctcctcgtcccttacttctcctggaagtacagccatcgacgccaccattccaacaccggatccctcgagagggatgaagtgttcgtccccaagaagaaatccgacagcaagtggtacggaaagtacctcaacaacccgcgaggacgcacggtgatgctaaccgtccaggtcacgctcggctggccctttgtacttag

SEQ ID NO: 50549 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttgg

SEQ ID NO: 50550 - DNA, 353 bp, Artificial
  Mutation in BnaC.FAD2.b introduced by TALE nuclease pair BnFAD2_T05
ctctcctccctcaccctatcccttacctcgcctggtccctctactgggcctgccaaggctgcgtcctaacgggcctctgggtcatcgcccacgacaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50551 - DNA, 360 bp, Artificial
  Mutation in BnaC.FAD2.b introduced by TALE nuclease pair BnFAD2_T05
cctctcctccctcacccgctcccttacctcgcctggcccctctcctgggcctgccaaggctgcgtccccacgagcctctgggtcatcgcccacgaatgcggcgccacgccttcagcgaccaccagtggctggacgacgccgtgggcctcgtcttccactccttcctcctcgtcccttacttctcctggaagtacagccatcgacgcatccattccaacaccggacccctcgagagggatgaagtgatcctccccaagaagaagaccgacataaagtggtacggagaggacctcaacaacccgcttggacgcacggtgaggcttaccgtgcatgtcacgcgtgcgcggcatgagtacttag

SEQ ID NO: 50552 - DNA, 359 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggatgcacggtgatgctaaccgtccagttcacgctcggcgggcctttgtacttag

SEQ ID NO: 50553 - DNA, 443 bp, Artificial
  Mutation in BnaC.FAD2.b introduced by TALE nuclease pair BnFAD2_T05
cctctcctccctcaccctctcccttacctcgcctggcccctctcctgggcctgccaaggctgcgtcctaacgggcctctgggtcatcgcccacgaatgcggccgctcaacttgaccccggagcaggtggcggccatcgccatgcctcctctagaccagccaggacagacatgcctcgacttcgccaccacgccttcagcgaccaccagtggctgcacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50554 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccagggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactcgcggctggcctttgtacttag

SEQ ID NO: 50555 - DNA, 447 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccgccattgctggcgatggccaccacctgctggggggtcaagccgtgggcctggcacagcaccggcaacagccgctggaccaccacgccttcagcgaccaccagtgtctggacgacgccgtgggcctcgtcttccactccttcctcctcgtcccttacttctcctggaagtacagccatcgacgccaccattccaacaccggatcccgcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50556 - DNA, 359 bp, Artificial
  Mutation in BnaC.FAD2.b introduced by TALE nuclease pair BnFAD2_T05
cctctcctccctcaccctctatcctacttcgcctggcctctctactgggcctgccaagggtgcgtcctaaccggcgtctgggtcatagcccacgagtgcggaccacgccttcagcgactaccagtggcttgacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50557 - DNA, 356 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggtcatagcccacgagtgcacacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttctcgctcgggtggcatttgtacttag

SEQ ID NO: 50558 - DNA, 358 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50559 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcggcccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50560 - DNA, 353 bp, Artificial
  Mutation in BnaC.FAD2.b introduced by TALE nuclease pair BnFAD2_T05
cctctcctccctcaccctctcccttacctcgcctggcacctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50561 - DNA, 360 bp, Artificial
  Mutation in BnaC.FAD2.b introduced by TALE nuclease pair BnFAD2_T05
cctctcctccctcaccctctctcctacttcgcctggcctctctactgggcctgccaaggctgcgtcctaacgggcctctgggtcatcgcccacgaatgcggcgccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50562 - DNA, 358 bp, Artificial
  Mutation in BnaC.FAD2.b introduced by TALE nuclease pair BnFAD2_T05
cctctcctccctcaccctctctcctacttcgcctcgcctctctactgggcctgccagggctgcgccctaaccggcgtctgggtcatcgcccacgaatgccaccacgcctgcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtagctcaacaagccgctaggacgcacggtgatgctaaccgtccagttcacgctcggctggcctttgtacttag

SEQ ID NO: 50563 - DNA, 353 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtaatgctaaccgtccagttcacgcgcggctggcctttgtacttag

SEQ ID NO: 50564 - DNA, 349 bp, Artificial
  Mutation in BnaC.FAD2.b introduced by TALE nuclease pair BnFAD2_T05
cctctcctccctcaccctctatcctacttcgcctggcctctctactgggcctgccagggctgcgtcctaaccggcgtctgggtcctagcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50565 - DNA, 346 bp, Artificial
  Mutation in BnaC.FAD2.b introduced by TALE nuclease pair BnFAD2_T05
cctctcctccctcaccctctcccttacctcgcctggcctctctactgggcctgccaaggctgcgtcctaacgggcctctgggtcatctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50566 - DNA, 390 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaagcggtgatcgccgaagtatcgactcaactatcagaggtagttggcgtcatcgagcgccatccaccacgccttcagcgaccaccagtggctggacgacgccgtgggcctcgtcttccactccttcctcctcgtcccttacttctcctggaagtacagccatcgacgccaccattctaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50567 - DNA, 358 bp, Artificial
  Mutation in BnaC.FAD2.b introduced by TALE nuclease pair BnFAD2_T05
cctctcctccctcaccctctcacttacctcgcctggcccctctactgggcctgccaaggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccacgaagaaaccccacatcaagtggtacggaaagtacctcaaccacccgctaggacgcccggtgatgcaaaccgtccagttcccgctcggctgccctctgtacttag

SEQ ID NO: 50568 - DNA, 359 bp, Artificial
  Mutation in BnaC.FAD2.b introduced by TALE nuclease pair BnFAD2_T05
cctctcctccctcaccctctaccttacctcgcctggcccctctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggccggcctttgtacttag

SEQ ID NO: 50569 - DNA, 357 bp, Artificial
  Mutation in BnaC.FAD2.b introduced by TALE nuclease pair BnFAD2_T05
cctctcctccctcaccctctcccttacctcgcctggcccctctaatgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcatgctcggctggcctttgtacttag

SEQ ID NO: 50570 - DNA, 319 bp, Artificial
  Mutation in BnaC.FAD2.b introduced by TALE nuclease pair BnFAD2_T05
cctctcctccctcaccctctctcctacttcgcctggcctctctactgggcctgccaagggtgcgtcctaaccggcgtctgggtcatagcccacgagtgcgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50571 - DNA, 364 bp, Artificial
  Mutation in BnaC.FAD2.b introduced by TALE nuclease pair BnFAD2_T05
cctctcctccctcaccctctcccttacctcgcctggcccctctactgggcctgtcaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgttgctaaccgtccagttcacgcgcggctggcctgtgtacttag

SEQ ID NO: 50572 - DNA, 354 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgacaccacgccttcagcgaccaccagtgactggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaattacctcaacaacccgctaggacgcacggtgatgctaaccgtccagttcacgctcggcaggcctttgtacttag

SEQ ID NO: 50573 - DNA, 447 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgctgcttgccaccattattgctggcgatggccaccacctgctggggggtcaagccgtgggcctggcacagcaccggcaacagccgctggaccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 50574 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctgtgggacgcaccgggatgttaacggttcagttcactctcggctggcctttgtacttag

SEQ ID NO: 50575 - DNA, 333 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgtggctggacgacgccgtgggcctcgtcttccactccttcctcctcgtcccttacttctcctggaagtacagccatcgacgccaccattacaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 50576 - DNA, 363 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgcggggccaccacgccttcagcgaccaccagtggctgtacgacgccgtgggcctcgtcttccactccttcctcctcgtcccttacttctcctggaagtacagccatcgacgccaccagtccaacaccggatccctcgagagggatgaagtgttcgtccccaagaagaaatccgacaccaagtggtacggaaagtacctcaacaacccgctaggacgcacggtgatgctaaccgtccagttcacgctcggctggcctttgtacttag

SEQ ID NO: 50577 - DNA, 362 bp, Artificial
  Mutation in BnaC.FAD2.b introduced by TALE nuclease pair BnFAD2_T05
cctctcctccctcaccctctctcctacttcgcctggcctctctactgggcctgccagggctgcgtcctaaccggcgtctgggccatagcccacgagtgcgggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50578 - DNA, 359 bp, Artificial
  Mutation in BnaC.FAD2.b introduced by TALE nuclease pair BnFAD2_T05
cctctcctccctcaccctctcacttacctcgcctggaccatctactgggcctgccaaggctgcgtcctaacgggcctctgggtcatcgcccacgaatgtccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 50579 - DNA, 394 bp, Artificial
  Mutation in BnaC.FAD2.b introduced by TALE nuclease pair BnFAD2_T05
cctctcctccctcaccctctcccttacctcgcctggcacctctactgggcctgccaaggctgcgtcctaacgggcctctgggtcatcgcccacgaatgcgacaaacaacagataaaacgaaaggcccagtcttcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50580 - DNA, 358 bp, Artificial
  Mutation in BnaC.FAD2.b introduced by TALE nuclease pair BnFAD2_T05
cctctcctccctcaccctctcccttacctcgcctggaccctctactgggcctgccaaggatgcgtcctaccgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50581 - DNA, 362 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatagcccacgagtgcggcccaccacgccttcagcgactaccagtggcttgacgacaccgtcggtctcctcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50582 - DNA, 392 bp, Artificial
  Mutation in BnaC.FAD2.b introduced by TALE nuclease pair BnFAD2_T05
cctctcctccctcaccctctctcctacttcgcctggcctatctcctgggcctgccaagggtgcgtcctaccaggcgtctgggtcatagcccacgagtgcttctagctgataaattcatgccggagagggtggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcgtctggcctgtgtacttag

SEQ ID NO: 50583 - DNA, 356 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaactggcacagcaccggcaacagccgctggacaacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50584 - DNA, 363 bp, Artificial
  Mutation in BnaC.FAD2.b introduced by TALE nuclease pair BnFAD2_T05
cctctcctccctcaccctctgccttacctcgcctggcccccctcctgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggatccctcgagagggctgaagtgttcgtccccaagaagaaatccgacatcaagtggtacggaaagcacctcaacaacccgctaggacgcacggtgatgctaaccttccagttcacgcgcggccggcctgtgtacttag

SEQ ID NO: 50585 - DNA, 362 bp, Artificial
  Mutation in BnaC.FAD2.b introduced by TALE nuclease pair BnFAD2_T05
cctctcctccctcaccctctctcctacttcgcctggcccctctactgggcctgccaaggctgcgtcctaacgggcctctgggtcatcgcccacgagtgccggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgttcggctggcctttgtacttag

SEQ ID NO: 50586 - DNA, 358 bp, Artificial
  Mutation in BnaC.FAD2.b introduced by TALE nuclease pair BnFAD2_T05
cctctcctccctcaccctctctcctacttcgcctggcctctctcctgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50587 - DNA, 358 bp, Artificial
  Mutation in BnaC.FAD2.b introduced by TALE nuclease pair BnFAD2_T05
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctacgacgcacggtgatgctaaccgtccagttcacgctcggctggcctttgtacttag

SEQ ID NO: 50588 - DNA, 358 bp, Artificial
  Mutation in BnaC.FAD2.b introduced by TALE nuclease pair BnFAD2_T05
cctctcctccctcaccctctcccttacctcgcctggcccctatcctgggcctgccaaggatgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccagtccaacaccggatccctcgagagggatgaagtgttcgtccccaagaagaaatccgacatcaagtggtacggaaattacctcagcaacccgctagggcgcgcggtgatgctgaccggtcagttcacgctgggcggtcttttgtgcttag

SEQ ID NO: 50589 - DNA, 355 bp, Artificial; identical to SEQ ID NO: 46102
  Mutation in BnaA.FAD2.a introduced by TALE nuclease pair BnFAD2_T07

SEQ ID NO: 50590 - DNA, 358 bp, Artificial; identical to SEQ ID NO: 47583
  Mutation in BnaA.FAD2.a introduced by TALE nuclease pair BnFAD2_T07

SEQ ID NO: 50591 - DNA, 346 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50592 - DNA, 282 bp, Artificial
  Mutation in BnaA.FAD2.a introduced by TALE nuclease pair BnFAD2_T07
cctctcctccctcaccctctctcctacacgctttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50593 - DNA, 358 bp, Artificial; identical to SEQ ID NO: 46174
  Mutation in BnaA.FAD2.a introduced by TALE nuclease pair BnFAD2_T07

SEQ ID NO: 50594 - DNA, 357 bp, Artificial; identical to SEQ ID NO: 46127
  Mutation in BnaA.FAD2.a introduced by TALE nuclease pair BnFAD2_T07

SEQ ID NO: 50595 - DNA, 358 bp, Artificial; identical to SEQ ID NO: 46282
  Mutation in BnaA.FAD2.a introduced by TALE nuclease pair BnFAD2_T07

SEQ ID NO: 50596 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 50597 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50598 - DNA, 352 bp, Artificial
  Mutation in BnaA.FAD2.a introduced by TALE nuclease pair BnFAD2_T07
cctctcctccctcaccctctctactacttcgcctggcctctctactgggcctgccaagggtgcgtcctaaccggcgtctgggtcatagcccacgagcacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50599 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50600 - DNA, 358 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtacttag

SEQ ID NO: 50601 - DNA, 358 bp, Artificial; identical to SEQ ID NO: 46457
  Mutation in BnaA.FAD2.a introduced by TALE nuclease pair BnFAD2_T07

SEQ ID NO: 50602 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtcctcaagaagaagtcagacatcaagtggtacggcaagtacctcaacaaccctttgggacgcaccgtgatgttaacggttcagttcactctcggctggcctttgtacttag

SEQ ID NO: 50603 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtggccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50604 - DNA, 298 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50605 - DNA, 350 bp, Artificial; identical to SEQ ID NO: 46328
  Mutation in BnaA.FAD2.a introduced by TALE nuclease pair BnFAD2_T07

SEQ ID NO: 50606 - DNA, 258 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50607 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50608 - DNA, 360 bp, Artificial; identical to SEQ ID NO: 46090
  Mutation in BnaA.FAD2.a introduced by TALE nuclease pair BnFAD2_T07

SEQ ID NO: 50609 - DNA, 342 bp, Artificial
  Mutation in BnaA.FAD2.a introduced by TALE nuclease pair BnFAD2_T07
cctctcctccctcaccctctctcctacttcgcctggcctctctattgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50610 - DNA, 298 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcctcgtcttccactccttcctcctcgtcccttacttctcctggaagtacagtcatcgacgccacaattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50611 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50612 - DNA, 345 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgattcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50613 - DNA, 282 bp, Artificial
  Mutation in BnaA.FAD2.a introduced by TALE nuclease pair BnFAD2_T07
cctctcctccctcaccctctctcctacacgctttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50614 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 50615 - DNA, 362 bp, Artificial; identical to SEQ ID NO: 46537
  Mutation in BnaA.FAD2.a introduced by TALE nuclease pair BnFAD2_T07

SEQ ID NO: 50616 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaacgggcctctgggtcatcgcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50617 - DNA, 357 bp, Artificial
  Mutation in BnaA.FAD2.a introduced by TALE nuclease pair BnFAD2_T07
cctctcctcctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50618 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50619 - DNA, 358 bp, Artificial; identical to SEQ ID NO: 46072
  Mutation in BnaA.FAD2.a introduced by TALE nuclease pair BnFAD2_T07

SEQ ID NO: 50620 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggcccaccacgccttcagcgcctaccagtggctggacgacaccgtcggcctcatcttccactccttcctcctcttcccttacttctcctggaagtacagtcatcgacgccaccattccaacactggctccctcgagagagacgaagtgtttgtccccaagaagaagacagacatcgagtggttcggaaagtacctcaacaaccctttgggacgcaccgtgatgttaacggttcagttcactcgcggctggcctttgtacttag

SEQ ID NO: 50621 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacttcaacaacccgttgggacgcacagtgatgttaacggttcagttcactctcggctggcctttgtacttag

SEQ ID NO: 50622 - DNA, 352 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctcttggtcatcgcccacgagcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50623 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtccgcctcctcttccactccttcctcctcgtcccttacttctcctggaagtacagtcatcgacgccaccattccaacactggctccctcgagagagacgaagtgtttgtccccaagaacaagtcagacatcaagtggtacggcaagtacctcaacaaccgtttgggacgcaccgtgatgtaaacggttcaggtcacgcccggctggcctttgcacttag

SEQ ID NO: 50624 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50625 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagactgcgtcctaaccggcgtctgggccatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcacgtcgttcgtcaactgcctcatcagacgtctagaagggacggtgacgcctcccgccccctccccgctcggctggcctttgtacttag

SEQ ID NO: 50626 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50627 - DNA, 358 bp, Artificial; identical to SEQ ID NO: 46249
  Mutation in BnaA.FAD2.a introduced by TALE nuclease pair BnFAD2_T07

SEQ ID NO: 50628 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaacaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50629 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagaaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50630 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcaccacgccttcagcgactaccagtggcttgacgacaccatcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50631 - DNA, 344 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggctaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50632 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50633 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtcaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaccaaccctttgggacgcaccgtgatgttaacggttcagttcactctcggctggcctttgtacttag

SEQ ID NO: 50634 - DNA, 352 bp, Artificial
  Mutation in BnaA.FAD2.a introduced by TALE nuclease pair BnFAD2_T07
cctctcctccctcaccctctctcctacttcttctggcctctctactgtgcctgccagggctgcgtcctaaccggcgtctgggtcatagcccacgagcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtccgtcaagtcccccaccgacccggaagtacacaaggtgcagcttcccctccatttcccgctcggctggcctttgtacttag

SEQ ID NO: 50635 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgctgttaacggttcagttcactctcggctggcctttgtacttag

SEQ ID NO: 50636 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacaaccctttgggacgcaccgtgatgttaacggttcagttcactctcggctggcctttgtacttag

SEQ ID NO: 50637 - DNA, 362 bp, Artificial
  Mutation in BnaA.FAD2.a introduced by TALE nuclease pair BnFAD2_T07
cctctcctccctcaccctctctcctacttcgcctggcctctatactgggcctgccaagggtgcgtcctaacgggcctctgggtcatcgcccacgaatgcgggccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50638 - DNA, 452 bp, Artificial
  Mutation in BnaA.FAD2.a introduced by TALE nuclease pair BnFAD2_T07
cctctcctccctcaccctctcccttacctcgcctggcctctctactgggcctgccaagggtgcgtcctaaccggcgtctgggtcatagcccacgagtgcggccatcctgacggtgatcagccactggtaacaggattagcagagcgaggtatgtaggcggtgctacagagttcttgaagtggtggcctaaggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50639 - DNA, 406 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgctgctggcgatggccaccacctgctggggggtcaagccgtgggcctggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50640 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 50641 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50642 - DNA, 357 bp, Artificial; identical to SEQ ID NO: 46522
  Mutation in BnaA.FAD2.a introduced by TALE nuclease pair BnFAD2_T07

SEQ ID NO: 50643 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 50644 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 50645 - DNA, 412 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggactgcaatttggagaatggcagcgcaatgacattcttgcaggtatcttcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50646 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaatcggcgtctaggtcatagcccacgagtgtgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50647 - DNA, 347 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgcgtcctaacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50648 - DNA, 409 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgtgccaggcccatgcatgcactgacgggtgccccgctcaacttgaccccggagcaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50649 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50650 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 50651 - DNA, 387 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggtggcaagcaggcgctggagacggtgcggaccacgccttcagcgaccaccagtggctggacgacaccgtcggcctcatcttccactccttcctcctcgtcccttacttctcctggaagtaaagtcatcgacgccaccattccaacactgactccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50652 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccatgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50653 - DNA, 364 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50654 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcaaccatcaagtggtacggcaagtacctcaacacccctttggagcgcaccttgatgttatcggtacagttcactctcggctggcctttatacctag

SEQ ID NO: 50655 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtacgccttcagcgactaccagtggctggacgacaccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 50656 - DNA, 350 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaacgccttcagcgaccaccagtggctggacgacaccgtcggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50657 - DNA, 353 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagtgacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50658 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50659 - DNA, 341 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtggctaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50660 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaccacgccttcagcgaccaccagtggctggaccacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50661 - DNA, 442 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtttggaccgtctccagcgcctgcttgccgccatcgtggctggcgatggccaccacctgctccggggtcaagccgtgggcctggcagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50662 - DNA, 358 bp, Artificial
  Mutation in BnaA.FAD2.a introduced by TALE nuclease pair BnFAD2_T07
cctctcctccctcaccctctctcctccttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50663 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgttaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50664 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50665 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgctaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50666 - DNA, 358 bp, Artificial
  Mutation in BnaA.FAD2.a introduced by TALE nuclease pair BnFAD2_T07
cctctcctccctcaccttctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50667 - DNA, 360 bp, Artificial
  Mutation in BnaA.FAD2.a introduced by TALE nuclease pair BnFAD2_T07
cctctcctccctcaccctctctcctacttcgcctggactctctactgggcctgccagggctgcgtcctaaccggcgtctgggtcatagcccacgagtgcggccacacgccttcagcgactaccaggggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50668 - DNA, 362 bp, Artificial; identical to SEQ ID NO: 46406
  Mutation in BnaA.FAD2.a introduced by TALE nuclease pair BnFAD2_T07

SEQ ID NO: 50669 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcaggtcactctcggctgccctgtgtacttag

SEQ ID NO: 50670 - DNA, 350 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50671 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgcggctcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50672 - DNA, 352 bp, Artificial
  Mutation in BnaA.FAD2.a introduced by TALE nuclease pair BnFAD2_T07
cctctcctccctcaccctctcccttacttcgcctggcccctctactgggcctgccaaggctgcgtcctaaccggcgtctgggtcatagcccacgagtacgccttcagcgactaccagtggcttgacgacaccgtcggcctcatcttccactccttcctcctcgtcccttacttctcctggaagtacagtcatcgacgccaccattccaacacttgctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 50673 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaggccttcagcgactaccagtggctggacgacaccgtctgcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcagcaaccgttcgggacgcaccgtgatgttaacggttcagttcactctcggctggcctttgtacttag

SEQ ID NO: 50674 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtaatcgcccacgaatgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50675 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaaaactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50676 - DNA, 358 bp, Artificial; identical to SEQ ID NO: 46556
  Mutation in BnaA.FAD2.a introduced by TALE nuclease pair BnFAD2_T07

SEQ ID NO: 50677 - DNA, 359 bp, Artificial; identical to SEQ ID NO: 46139
  Mutation in BnaA.FAD2.a introduced by TALE nuclease pair BnFAD2_T07

SEQ ID NO: 50678 - DNA, 354 bp, Artificial
  Mutation in BnaA.FAD2.a introduced by TALE nuclease pair BnFAD2_T07
cctcttctccctcaccctctctcctacttcgcctggcctctctactgggcctgccagggctgcgtcctaaccggcgtctgggtcatagcccacgagtaccacgccttcagcgactaccagtggcttgacgacaccgtcggtctcatcttccactccttcctcctctccccttacctctcctggaagtacagtcatcgacgccaccattccaacacttgctccctcgagagagacgaagtgtttgtcccccagaagaaatccgacatcaagtggtacggcaagtgcctcaacaaccctttgggacgccccgtgatgttaacggttcagttcactctcggctgccctttgtattag

SEQ ID NO: 50679 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatcgcccacgaatgcggccagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50680 - DNA, 282 bp, Artificial
  Mutation in BnaA.FAD2.a introduced by TALE nuclease pair BnFAD2_T07
cctctcctccctcaccctctctcctacacgctttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcactctcggctggcctttgtacttag

SEQ ID NO: 50681 - DNA, 265 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagtgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50682 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50683 - DNA, 358 bp, Artificial
  Mutation in BnaA.FAD2.a introduced by TALE nuclease pair BnFAD2_T07
cctctcctccctcaccctctcccttacctcgcctggcccatctactgggcctgccaaggctgcgtcctaaccggcgtctgggtcatagcccactagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50684 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50685 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccactagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50686 - DNA, 365 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50687 - DNA, 363 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacgacaagtacctcaacaaccctttgggacgcaccgtgatgttaacggttcagttcactctcggctggcctttgtacttag

SEQ ID NO: 50688 - DNA, 364 bp, Artificial
  Mutation in BnaA.FAD2.a introduced by TALE nuclease pair BnFAD2_T07
ctctcctccctcaccctctctcctacttcgcctggcctctctactgggcatgccagggctgcgtcctaaccggcgtctgggtcatagcccacgagtgcggccggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50689 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50690 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgggatggtaacggttcagttcactctcggctggcctttgtacttag

SEQ ID NO: 50691 - DNA, 358 bp, Artificial
  Mutation in BnaA.FAD2.a introduced by TALE nuclease pair BnFAD2_T07
cctctcctccctcaccatctctcctacttcgcctggcccctctactgggcctgccaaggctgcgtcctaacgggcctctgggtcatcgcccacgaatgccaccacgccttcagcgaccaccagtggctggacgacgccgtgggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 50692 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50693 - DNA, 362 bp, Artificial
  Mutation in BnaA.FAD2.a introduced by TALE nuclease pair BnFAD2_T07
cctctcctccctcaccctctcccttacctcgcctggcctctctactgggcctgccaagggtgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 50694 - DNA, 359 bp, Artificial; identical to SEQ ID NO: 46144
  Mutation in BnaA.FAD2.a introduced by TALE nuclease pair BnFAD2_T07

SEQ ID NO: 50695 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcatcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 50696 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgtggtacttag

SEQ ID NO: 50697 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcacgccttcagcgactaccagtggctggacgacaccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50698 - DNA, 359 bp, Artificial
  Mutation in BnaA.FAD2.a introduced by TALE nuclease pair BnFAD2_T07
cctctcctccctcactctctcccttacctcgcctggcccctctactgggcctgccagggctgcgtcctaacgggcctctgggtcatcgcccacgaatgcccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50699 - DNA, 258 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50700 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50701 - DNA, 358 bp, Artificial
  Mutation in BnaA.FAD2.a introduced by TALE nuclease pair BnFAD2_T07
cctctcctccctcaccctctcccttacctcgcctggcccctctactggacctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50702 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctgtgtacttag

SEQ ID NO: 50703 - DNA, 358 bp, Artificial; identical to SEQ ID NO: 47022
  Mutation in BnaA.FAD2.a introduced by TALE nuclease pair BnFAD2_T07

SEQ ID NO: 50704 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50705 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 50706 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgctaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 50707 - DNA, 350 bp, Artificial
  Mutation in BnaA.FAD2.a introduced by TALE nuclease pair BnFAD2_T07
cctctcctccctcaccctctctactacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50708 - DNA, 360 bp, Artificial; identical to SEQ ID NO: 46717
  Mutation in BnaA.FAD2.a introduced by TALE nuclease pair BnFAD2_T07

SEQ ID NO: 50709 - DNA, 343 bp, Artificial
  Mutation in BnaA.FAD2.a introduced by TALE nuclease pair BnFAD2_T07
cctctcctccctcaccctctcccttacctcgcctggcccctctcctgagcctgccaaggctgcgtcctaacgggcctctgggtcatcgcccacgaatgcgatgaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 50710 - DNA, 360 bp, Artificial
  Mutation in BnaA.FAD2.a introduced by TALE nuclease pair BnFAD2_T07
cctctcctccctcaccctttatcctacttcgcctggcctctctactgggcctgccagggctgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctcccacgagagagacgaagtgtttgtccccaagaagaagtcacacatcaagtggtacggcaagtacctcaacgacccttagggacgcaccgtgatgttaacggttcagtgcactctcggctggcatttgtacttag

SEQ ID NO: 50711 - DNA, 341 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccataaatagccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50712 - DNA, 366 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcgactactccaccacgcgttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactcgcggctggcctttgtacttag

SEQ ID NO: 50713 - DNA, 358 bp, Artificial; identical to SEQ ID NO: 46286
  Mutation in BnaA.FAD2.a introduced by TALE nuclease pair BnFAD2_T07

SEQ ID NO: 50714 - DNA, 358 bp, Artificial
  Mutation in BnaA.FAD2.a introduced by TALE nuclease pair BnFAD2_T07
cctctcctccctcaccctctctcctacttcgcctggactctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 50715 - DNA, 359 bp, Artificial; identical to SEQ ID NO: 47439
  Mutation in BnaA.FAD2.a introduced by TALE nuclease pair BnFAD2_T07

SEQ ID NO: 50716 - DNA, 353 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50717 - DNA, 360 bp, Artificial
  Mutation in BnaA.FAD2.a introduced by TALE nuclease pair BnFAD2_T07
cctctcctccctcaccctctctcctacttcgcctggcccctctactgggcctgccagggctgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtggtgttaacggttcaggtcccgcccggctggcctttgcacttag

SEQ ID NO: 50718 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50719 - DNA, 358 bp, Artificial
  Mutation in BnaA.FAD2.a introduced by TALE nuclease pair BnFAD2_T07
cctctcctccctcaccctctctcctacttcgcctggcctatctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaaccctttgggacgcaccgtgatgttaacggttcagttcactcgcggctggcctttgtacttag

SEQ ID NO: 50720 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgctggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50721 - DNA, 367 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50722 - DNA, 346 bp, Artificial; identical to SEQ ID NO: 47712
  Mutation in BnaA.FAD2.a introduced by TALE nuclease pair BnFAD2_T07

SEQ ID NO: 50723 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50724 - DNA, 355 bp, Artificial
  Mutation in BnaA.FAD2.a introduced by TALE nuclease pair BnFAD2_T07
cctctcctccctcaccctctccattacctcgcctggcccctctactgggcctgccagggctgcgtcctaaccggcgtctgggtcatagcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 50725 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 50726 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 50727 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcgatgaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50728 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaccacgccttcagcgactaccagtggctggacgacaccgtcggcctcatcttccactccttcctcctcgtcccttacttctcctggaagtacagtcatcgacgccaccattccaacactggctcctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50729 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50730 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50731 - DNA, 452 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcggccatcctgacggtgatcagccactggtaacaggattagcagagcgaggtatgtaggcggtgctacagagttcttgaagtggtggcctaaggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 50732 - DNA, 368 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatatctttggtgaccgtaacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50733 - DNA, 282 bp, Artificial
  Mutation in BnaA.FAD2.a introduced by TALE nuclease pair BnFAD2_T07
cctctcctccctcaccctctctcctacatgctttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcaccctcggctggcctttgtacttag

SEQ ID NO: 50734 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaacccgttgggacgcaccgtgatgttaacggttcagttcactcgcggctggccttagtacttag

SEQ ID NO: 50735 - DNA, 281 bp, Artificial
  Mutation in BnaA.FAD2.a introduced by TALE nuclease pair BnFAD2_T07
cctctcctccctaccctctctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50736 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgaggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 50737 - DNA, 358 bp, Artificial
  Mutation in BnaA.FAD2.a introduced by TALE nuclease pair BnFAD2_T07
cctctcctccctcaccctctcccttacctcgcctggcccctctcctgggcctgccaaggctgcgtcctaacgggcctctgggtcatcgcccacgaatgctaccacgccttcagcgaccaccagtggctggacgacgccgtgggcctcatcttcaactccttcctcctcgtcccttacttctcctggaagtacagtcatcgacgccaccattccaacactggctcactcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 50738 - DNA, 354 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50739 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50740 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctaggtcatagcccacgagtgtgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50741 - DNA, 343 bp, Artificial
  Mutation in BnaA.FAD2.a introduced by TALE nuclease pair BnFAD2_T07
cctctcctccctcaccctctctcctacttcgcctggccactctactgggcctgccaaggctgcgtcctaacgggcctctgggtcatcgcccacgaatgcgatgaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctgtgggacgcaccgtgatgttaacggttcagttcactctcggctggcctttgtacttag

SEQ ID NO: 50742 - DNA, 412 bp, Artificial
  Mutation in BnaA.FAD2.a introduced by TALE nuclease pair BnFAD2_T07
cctctcctccctcaccctctctcctacttcgcctggcctatctactgggcctgccagggctgcgtcctaaccggcgtctgggtcatagcccacgagtgcggactgcaatttggagaatggcagcgcaatgacattcttgcaggtatcttcggccaccacgccttcagcgactaccagtggctggacgccaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcattcgcggctggcctttgtacttag

SEQ ID NO: 50743 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatcgcccacgaatgcgaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50744 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagccatcaagtggtccggcaagtacctcaccaaccctctgggacgcaccgtgatgttaacggttcaggtcactctcggctggcctgtgtacttag

SEQ ID NO: 50745 - DNA, 358 bp, Artificial
  Mutation in BnaA.FAD2.a introduced by TALE nuclease pair BnFAD2_T07
cctctcctccctcaccctctcccttacctcgcctgccccctctactgagcctgccaaggctgcgtcctaacgggcctctgggtcatcgcccacgaatgcgaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50746 - DNA, 364 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgaggttaacggtgcagttcactctcggctggcctttgtacttag

SEQ ID NO: 50747 - DNA, 351 bp, Artificial
  Mutation in BnaA.FAD2.a introduced by TALE nuclease pair BnFAD2_T07
cctctcctcctcaccctctctcctacttcgcctggcctctctactgggcctgccaagggtgcgtcctaaccggcgtctgggtcatagcccacgagtacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50748 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccatcctcctcgtcccttacttctcctggaagtacagtcatcgacgccaccattccaacactggctccctcgagagagacgaagtgtttgtccccaagaagaagtcagacatcaagtggtacggcaagtacctcaacaacactttgggacgcaccgtgatgttaacggttcagttcactctcggctggcctttgtacttag

SEQ ID NO: 50749 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggaccacgccttcagcgactaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 50750 - DNA, 358 bp, Artificial
  Mutation in BnaA.FAD2.a introduced by TALE nuclease pair BnFAD2_T07
cctctcctccctcaccctctctcctacttcgcctggcctctatactgggcctgccaagggtgcgtcctaaccggcgtctgggtcatagcccacgagtgccaccacgccttcagcgaccaccagtggatggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 50751 - DNA, 343 bp, Artificial; identical to SEQ ID NO: 47972
  Mutation in BnaA.FAD2.a introduced by TALE nuclease pair BnFAD2_T07

SEQ ID NO: 50752 - DNA, 342 bp, Artificial
  Mutation in BnaA.FAD2.a introduced by TALE nuclease pair BnFAD2_T07
cctctcctccctcaccctctcccttacctcgcctggcctctctattgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50753 - DNA, 352 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgagcacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50754 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgtgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50755 - DNA, 358 bp, Artificial; identical to SEQ ID NO: 46121
  Mutation in BnaA.FAD2.a introduced by TALE nuclease pair BnFAD2_T07

SEQ ID NO: 50756 - DNA, 354 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggctttgtacttag

SEQ ID NO: 50757 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50758 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50759 - DNA, 360 bp, Artificial
  Mutation in BnaA.FAD2.a introduced by TALE nuclease pair BnFAD2_T07
cctctcctccctcaccctttctcctacttcgcctggcctctctactgggcctgccagggctgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50760 - DNA, 354 bp, Artificial
  Mutation in BnaA.FAD2.a introduced by TALE nuclease pair BnFAD2_T07
cctctcctccctcaccctctcccttacctcgcctggccactctactgggcctgccaagggtgcgtcctaaccggcgtctgggtcatagcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcctttgtacttag

SEQ ID NO: 50761 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50762 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccaccgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50763 - DNA, 357 bp, Artificial
  Mutation in BnaA.FAD2.a introduced by TALE nuclease pair BnFAD2_T07
cctctcctccctcaccctctcccctacctcgcctggcccctctactgggcctgccaaggctgcgtcctaaccggcgtctgggtcatagcccacgagtgcaccacgcactcagcgactaccagcggctggacgacaccgtcggcctcatcttccactccttcctcctcgtcccttacttctcctggaagtacagtcatcgacgccaccattccaacactggctccctcgagagagacgaagtgtttgtccccaagaagaaatcagacatcaagtggtacggcaagtacctcaacaaccctttgggacgcaccgtgatgttaaccgttcagttcactctcggctggcctttgtacttag

SEQ ID NO: 50764 - DNA, 352 bp, Artificial
  Mutation in BnaA.FAD2.a introduced by TALE nuclease pair BnFAD2_T07
cctctcctccctcaccctctcccttacctcgcctggcctctctactgggcctgccaagggtgcgtcctaaccggcgtctgggtcatagcccgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50765 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcccaccacgccttcagcgactaccagtggatggacgacaccgtcggcctcatcttccactacttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggactcaccgtgatgttaacggttcagttcactctcggctggcctttgtacttag

SEQ ID NO: 50766 - DNA, 265 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 50767 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 50768 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctgtgtacttag

SEQ ID NO: 50769 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50770 - DNA, 390 bp, Artificial
  Mutation in BnaA.FAD2.a introduced by TALE nuclease pair BnFAD2_T07
cctctcctcactcaccctctctcctacttcgcctggcctctctactgggcctgccagggctgcgtcctaaccggcgtctgggtcatagcccacgagtgcggacaatggtgacttctacagcgcggagaatcttccactccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacaacaagtggtacggaaagtacctcaacaacccgctaggacgcacggtgatgctaaccgtccagttcacgctcggctggcctttgtacttag

SEQ ID NO: 50771 - DNA, 358 bp, Artificial
  Mutation in BnaA.FAD2.a introduced by TALE nuclease pair BnFAD2_T07
cctctcctccctcaccctctcccttacctcgcctgccccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccatactgttaacggtacagttcactctcggctggcctttgtacttag

SEQ ID NO: 50772 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaataagtcagacatcaagtggtacggcaagtacctcaacaaccctttgggacgcaccgtgatgttaacggttcagttcactctcggctggcctttgtacttag

SEQ ID NO: 50773 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagcccgttgggacgcaccgtgatgttaacggttcagttcactctcggctggccattgtacttag

SEQ ID NO: 50774 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgagtgcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 50775 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50776 - DNA, 358 bp, Artificial; identical to SEQ ID NO: 46927
  Mutation in BnaA.FAD2.a introduced by TALE nuclease pair BnFAD2_T07

SEQ ID NO: 50777 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 50778 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgcaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50779 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaaccgtccagttcacgctcggctggcctttgtacttag

SEQ ID NO: 50780 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactatcggctggcctttgtacttag

SEQ ID NO: 50781 - DNA, 345 bp, Artificial
  Mutation in BnaA.FAD2.a introduced by TALE nuclease pair BnFAD2_T07
cctctcctccctcaccctctctcctacttcgcctggcctctctcctgggcctgccaagggtgcgtcctaaccggcgtctgggtcatcgcccacgattcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcatttgtacttag

SEQ ID NO: 50782 - DNA, 299 bp, Artificial
  Mutation in BnaA.FAD2.a introduced by TALE nuclease pair BnFAD2_T07
cctctcctccctcaccctctctcctacttcgcctcgcctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctgtgtacttag

SEQ ID NO: 50783 - DNA, 355 bp, Artificial
  Mutation in BnaA.FAD2.a introduced by TALE nuclease pair BnFAD2_T07
cctctcctccctcaccctctctcctacttcgcctggcctctctcctcagcctgccagggctgcgtcctaacgggcctctgggtcatagcccacgagcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 50784 - DNA, 358 bp, Artificial
  Mutation in BnaA.FAD2.a introduced by TALE nuclease pair BnFAD2_T07
cctctcctccctcaccctctctcctacttcgcctggcccctctactgggcctgtcaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 50785 - DNA, 353 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50786 - DNA, 349 bp, Artificial
  Mutation in BnaA.FAD2.a introduced by TALE nuclease pair BnFAD2_T07
cctctcctccctcaccctctcccttacctcgcctggcccctctcctgggcctgccaaggctgcgtcctaacgggcctctgggtcatcgcccaccacgccttcagcgaccaccagtggctggacgacgccgtggtcctcgtcttccactccttcctcctcgtcccttacttctccttgaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcgactggcctttgtacttag

SEQ ID NO: 50787 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtggccaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50788 - DNA, 357 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgagtgtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50789 - DNA, 358 bp, Artificial
  Mutation in BnaA.FAD2.a introduced by TALE nuclease pair BnFAD2_T07
cctctcctccctcaccctctccattacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50790 - DNA, 363 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggcccaccacgccttcagcgactaccagtggctggacgacaccgtcggcctcatcttccactccttcctcctcgtcccttacttctcctggaaggacagtcatcgacgccaccattccaacactggctccctcgcgagagacgaagtgtttgtccccaagaagaagtcagacatcgagtggtacggcgagtccctcaacacccctttgggacgcaccgtgatgttaacggttcagttcactctcggctggcctttgtacttag

SEQ ID NO: 50791 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50792 - DNA, 282 bp, Artificial
  Mutation in BnaA.FAD2.a introduced by TALE nuclease pair BnFAD2_T07
cctctcctccctcaccctctctcctacacgctctcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50793 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50794 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50795 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggctcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50796 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtccttag

SEQ ID NO: 50797 - DNA, 358 bp, Artificial; identical to SEQ ID NO: 46170
  Mutation in BnaA.FAD2.a introduced by TALE nuclease pair BnFAD2_T07

SEQ ID NO: 50798 - DNA, 341 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtggctaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50799 - DNA, 362 bp, Artificial
  Mutation in BnaA.FAD2.a introduced by TALE nuclease pair BnFAD2_T07
cctctcctccctcaccctctctccttcttcgcctggcctctctactgggcctgccagggctgcgtcctaaccggcgtctgggtcatagcccacgagtgcggcccaccacgccttaagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50800 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50801 - DNA, 347 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgcgtcctaacaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacacaccgtgatgttaacggttcagttcactctcggctggcctttgtacttag

SEQ ID NO: 50802 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagtgcggcccaccacgccttcagcgaccaccagtggctggacgacgccatgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50803 - DNA, 459 bp, Artificial
  Mutation in BnaA.FAD2.a introduced by TALE nuclease pair BnFAD2_T07
cctctcctccctcaccctctctcctacttcgcctcgcctctctactgggcctgccagggctgcgtcctaaccggcgtctgggtcatagcccacgagtgcggctgttgccggtgctgtgccaggcccacggcttgaccccccagcagggagtggccatcgccagcaataatggtggcaagcaggcgctggagacggtcggccaccacgccttcagcgactaccagtggctggacgacaccgtcggcctcatcttccactccctcctcctcgtccctcacttctcctggaagtacagccatcgacgccaccattccaacaccggatccctcgagagtgatgaagtgtttgtccccaagaagaagtcagacatcaagtgttacggcaagtacctcaacatccctttgggacgcaccgtgatgttaacggttcagttcactctcggctggcctttgtaattag

SEQ ID NO: 50804 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50805 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50806 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50807 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50808 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaacaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 50809 - DNA, 363 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50810 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 50811 - DNA, 356 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcataacgggcctctgggtcatcgcccacgaatgaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50812 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50813 - DNA, 354 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctgccctgtgtacttag

SEQ ID NO: 50814 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 50815 - DNA, 330 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50816 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccatcccaacactggctccctcgagagagacgaagtgttcgtccccaagaagaaatccgacatcaagtggtacggaaagtacctcaacaacccgctaggacgcactgtgatgctaaccgtccagttcacgctcggctggcctttgtacttag

SEQ ID NO: 50817 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccacctttccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50818 - DNA, 345 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgattcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50819 - DNA, 347 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50820 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcagcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50821 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 50822 - DNA, 355 bp, Artificial
  Mutation in BnaA.FAD2.a introduced by TALE nuclease pair BnFAD2_T07
cctctcctccctcaccctctaccttacctcgcctggcccctctactgggcctgccaaggctgcgtcctaacgggcctctgggtcatcgcccacgaacaccacgccttcagcgaccaccagtggctggacgacgccgtgggcctcgtcttccactccttcctcctcgtcccttacttctcctggaagtacagtcatcgacgccaccattctaacactggctccctcgagagagacgaagtgtttgtccccaagaagaagtcagacatcaagtggtacggcaagtacctcaacaaccctttgagacgcaccgtgatgttaacgggtcatttcactctcggctggcctttgtgcttag

SEQ ID NO: 50823 - DNA, 384 bp, Artificial
  Mutation in BnaA.FAD2.a introduced by TALE nuclease pair BnFAD2_T07
cctctcctccctcaccctctcctacttcgcctggcccctctactgggcctgccaaggctgcgtcctaacgggcctctgggtcatcgcccacgaatgcgatcgagatcgcccggaacagcacccaccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50824 - DNA, 363 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgtgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtgttacggcaagtacctcaacatccctttgggacgcactgtgattttaacggttcagttcacgctcggctggcctttgtacttag

SEQ ID NO: 50825 - DNA, 393 bp, Artificial
  Mutation in BnaA.FAD2.a introduced by TALE nuclease pair BnFAD2_T07
cctctcctccctcaccctctcccttacctcgcctggcccctctactgggcctgccaaggatgcgtcctaacgggcctctgggtcatcgcccacgaatgcagcgcctgcttgccaccattattgctggcgatggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50826 - DNA, 465 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcctctgggtcatcgcccacgaatgcgtgtccagcgcctgcttgccgccatcgtggctggcgatggccaccacctgctccggggttaagccgtgggcctggcacagcaccggcaacagccgctggaccgtctccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50827 - DNA, 281 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttttacttag

SEQ ID NO: 50828 - DNA, 346 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50829 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 50830 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaagggtacgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagttgtacggcaagtacctcaacaaccctttgggacgcaccgtgatgttaacggttcagttcactctcggctggcctttgtacttag

SEQ ID NO: 50831 - DNA, 363 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgggcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50832 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50833 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 50834 - DNA, 342 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacttcaagtggtacggcaagtacctcaacaaccctttgggacgcaccgtgatgttaacggttcagttcactctcggctggcctttgtacttag

SEQ ID NO: 50835 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50836 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50837 - DNA, 358 bp, Artificial; identical to SEQ ID NO: 46461
  Mutation in BnaA.FAD2.a introduced by TALE nuclease pair BnFAD2_T07

SEQ ID NO: 50838 - DNA, 342 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50839 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50840 - DNA, 412 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcggactgcaatttggagaatggcagcgcaatgacattcttgcaggtatcttcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50841 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50842 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50843 - DNA, 357 bp, Artificial
  Mutation in BnaA.FAD2.a introduced by TALE nuclease pair BnFAD2_T07
ccttcctccctcaccctctctcctacttcgcctggcctctctactgcgcctgccagggctgcgtcctaaccggcgtctgggtcatagcccacgagtgccaccacgccttcagcgactaccggtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50844 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 50845 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50846 - DNA, 365 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 50847 - DNA, 368 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgaatatctttggtgaccgtaacgccttcagcgaccaccagtggctggacgacgccgtgggcctcgtcttccactccttcctcctcgtcccttacttctcctggaagtacagccatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50848 - DNA, 356 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctcaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50849 - DNA, 355 bp, Artificial; identical to SEQ ID NO: 46228
  Mutation in BnaA.FAD2.a introduced by TALE nuclease pair BnFAD2_T07

SEQ ID NO: 50850 - DNA, 417 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggtggtggcactgacgggtgccccgctcaacttgaccccggagcaggtggtggccatcgtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50851 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgagtgcgttaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50852 - DNA, 355 bp, Artificial
  Mutation in BnaA.FAD2.a introduced by TALE nuclease pair BnFAD2_T07
cctctcctccatcaccctctctcctacttcgcctggcctctctactgggcctgccagggctgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50853 - DNA, 284 bp, Artificial
  Mutation in BnaA.FAD2.a introduced by TALE nuclease pair BnFAD2_T07
cctctcctccctcaccacctctgaccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50854 - DNA, 357 bp, Artificial; identical to SEQ ID NO: 46211
  Mutation in BnaA.FAD2.a introduced by TALE nuclease pair BnFAD2_T07

SEQ ID NO: 50855 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50856 - DNA, 356 bp, Artificial
  Mutation in BnaA.FAD2.a introduced by TALE nuclease pair BnFAD2_T07
cctctcctcctcaccctctcccatacctcgcctggcccctctactgggcctgcaaaggctgcgtcctaacgggcctctgggtcatcgccaacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50857 - DNA, 347 bp, Artificial
  Mutation in BnaA.FAD2.a introduced by TALE nuclease pair BnFAD2_T07
cctctcctccctcaccctctctcctacttcgcctggcctctctacttggcctgccagggctgcgtcctaacgggcctctgggtcatcgcaccacgccttcagcgactaccagtggctggacgacaccgtcggcctcatctcccactccttcctcctcgtcccttacttctcctggaagtacagtcatcgacgccaccatgccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50858 - DNA, 362 bp, Artificial
  Mutation in BnaA.FAD2.a introduced by TALE nuclease pair BnFAD2_T07
cctctcctccctcaccctctctcctacttcgcctcgcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50859 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50860 - DNA, 343 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgatgaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50861 - DNA, 354 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50862 - DNA, 353 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccacaagaagaaatccgacatcaagtggtacggaaagtacctcaacaacccgctaggacgcacggtgatgctaaccgtccagttcacgctcggctggcctttgtacttag

SEQ ID NO: 50863 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 50864 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagaaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50865 - DNA, 350 bp, Artificial; identical to SEQ ID NO: 48095
  Mutation in BnaA.FAD2.a introduced by TALE nuclease pair BnFAD2_T07

SEQ ID NO: 50866 - DNA, 326 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaataagaagtcagacatcaagtggtacggcaagtacctcaacaaccctttgggacgcaccgtgatgttaacggttcagttcactctcggctggccctttgtacttag

SEQ ID NO: 50867 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaagtacctcaacaacccgctaggacgcacggtgatgctaaccgtccagttcacgctcggctggcctgtgtacttag

SEQ ID NO: 50868 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50869 - DNA, 365 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50870 - DNA, 358 bp, Artificial; identical to SEQ ID NO: 46881
  Mutation in BnaA.FAD2.a introduced by TALE nuclease pair BnFAD2_T07

SEQ ID NO: 50871 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgctaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50872 - DNA, 359 bp, Artificial; identical to SEQ ID NO: 46091
  Mutation in BnaA.FAD2.a introduced by TALE nuclease pair BnFAD2_T07

SEQ ID NO: 50873 - DNA, 356 bp, Artificial
  Mutation in BnaA.FAD2.a introduced by TALE nuclease pair BnFAD2_T07
ctctcctccctcaccctctctcctacttcgcctggcctctctactgggcctgccagggctgcgtcctaaccggcgtctgggtcatagcccacgaatgaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50874 - DNA, 353 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50875 - DNA, 343 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgatgaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50876 - DNA, 375 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaaacaaaccaccgctcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgccccgtgatgttaacggttcagttcactctcggctggccttgcacttag

SEQ ID NO: 50877 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatattaacgtttcatttcactctcggctgccctttgtacttag

SEQ ID NO: 50878 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgcggcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctgtgtacttag

SEQ ID NO: 50879 - DNA, 358 bp, Artificial
  Mutation in BnaA.FAD2.a introduced by TALE nuclease pair BnFAD2_T07
cctctcctccctcaccctctcccttacctcgcctggcccctctcctgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacagccctgtgggacgcgccgggatgttagcggtgcggttcactcgcgggtggcctgggtacgtag

SEQ ID NO: 50880 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcgctctcggctggcctttgtacttag

SEQ ID NO: 50881 - DNA, 345 bp, Artificial
  Mutation in BnaA.FAD2.a introduced by TALE nuclease pair BnFAD2_T07
cctctcctccctcaccctctctcctacttcgcctggcctctctactgcgcctgccagggctgcgtcctaaccggcgtctgggtcatagcccacgattcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggcgggcctttgtacttag

SEQ ID NO: 50882 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50883 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcctctgggtcatcgcccacgaacaccacgccttcagctaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50884 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50885 - DNA, 362 bp, Artificial
  Mutation in BnaA.FAD2.a introduced by TALE nuclease pair BnFAD2_T07
cctctcctccctcaccctctaccttacctcggctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50886 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 50887 - DNA, 404 bp, Artificial
  Mutation in BnaA.FAD2.a introduced by TALE nuclease pair BnFAD2_T07
cctctcctccctcaccctctctactacttcgcctggcctctctactgggcctgccagggctgcgtcctaaccggcgtctgggtcatagcccacgagtgcggccaccacctgctggggggtcaagccgtgggcctggcacagcaccggcaacgccttcagcgactaccagtggcttgacgacaccgtcggtctcatcttccactccttcctcctggtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50888 - DNA, 362 bp, Artificial
  Mutation in BnaA.FAD2.a introduced by TALE nuclease pair BnFAD2_T07
cctctcctccctcaccctctctcctacttcgcctggcctctctactggtcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50889 - DNA, 357 bp, Artificial; identical to SEQ ID NO: 46082
  Mutation in BnaA.FAD2.a introduced by TALE nuclease pair BnFAD2_T07

SEQ ID NO: 50890 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcacgctcggctggcctttgtacttag

SEQ ID NO: 50891 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgcaccacgccttcagcgactaccagtggctggacgacaccgtcggcctcatcttccactccttcctcctcgtcccttacttcgcctggaagtacagtcatcgacgccaccatgccaacactggcgccctcgagagagacgaagtgtttgtccccaagaagaaggcagacatcaagtggtacgggaagtaccgcaacaaccgtttgggacggagcgtgagggtaaggggggggttcggtcgcggctggcctgtgtgcgtag

SEQ ID NO: 50892 - DNA, 358 bp, Artificial; identical to SEQ ID NO: 46826
  Mutation in BnaA.FAD2.a introduced by TALE nuclease pair BnFAD2_T07

SEQ ID NO: 50893 - DNA, 359 bp, Artificial; identical to SEQ ID NO: 47325
  Mutation in BnaA.FAD2.a introduced by TALE nuclease pair BnFAD2_T07

SEQ ID NO: 50894 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50895 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggaccacgccttcagcgactaccagaggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50896 - DNA, 360 bp, Artificial
  Mutation in BnaA.FAD2.a introduced by TALE nuclease pair BnFAD2_T07
cctctcctccctcaccctctctcctacttcgcctgacctctctactgagcctgccagggctgcgtcctaaccggcgtctgggtcatagcccacgagtgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcgctctcggctggcctttgtacttag

SEQ ID NO: 50897 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaacctgccagttcacgctcggctggcctttgtacttag

SEQ ID NO: 50898 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50899 - DNA, 361 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtgcggtccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 50900 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 50901 - DNA, 282 bp, Artificial
  Mutation in BnaA.FAD2.a introduced by TALE nuclease pair BnFAD2_T07
cctctcctccctcaccctctctccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50902 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50903 - DNA, 358 bp, Artificial
  Mutation in BnaA.FAD2.a introduced by TALE nuclease pair BnFAD2_T07
cctctcctccctcaccctctcccttacctcgcctggcccctcttctgggcctgccaaggctgcgtcctaacgggcctctgggtcatcgcccacgaatgctaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgggatgttaacggttcagttcactctcggctggcctttgtacttag

SEQ ID NO: 50904 - DNA, 358 bp, Artificial
  Mutation in BnaA.FAD2.a introduced by TALE nuclease pair BnFAD2_T07
cctctcctccctcaccctctcccttacctcgcctggcccctctactgggcctgtcaaggctgcgtcctaacgggcctctgggtcatcgcccacgagtgccaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 50905 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50906 - DNA, 358 bp, Artificial
  Mutation in BnaA.FAD2.a introduced by TALE nuclease pair BnFAD2_T07
cctctcctccctcaccctctctcctacttcgtctgccctctttactggtccacacatctctgcgccctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttggtgcgcaccgtgatgttaacggtccagttcactctcggctggcctttgtacttag

SEQ ID NO: 50907 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50908 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50909 - DNA, 330 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggttcggcaagcaccccaacctccctctgggccgcaccgtgatttaaacggtacagttccctcgaggacgccctctgtacctag

SEQ ID NO: 50910 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggtgcagttcactctcggctggcctttgtacgtag

SEQ ID NO: 50911 - DNA, 423 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggtcaggtggtggccatcgccagcaatggcggtggcaagcaggcgctggagacggtccagcggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50912 - DNA, 362 bp, Artificial; identical to SEQ ID NO: 46499
  Mutation in BnaA.FAD2.a introduced by TALE nuclease pair BnFAD2_T07

SEQ ID NO: 50913 - DNA, 358 bp, Artificial; identical to SEQ ID NO: 46165
  Mutation in BnaA.FAD2.a introduced by TALE nuclease pair BnFAD2_T07

SEQ ID NO: 50914 - DNA, 349 bp, Artificial
  Mutation in BnaA.FAD2.a introduced by TALE nuclease pair BnFAD2_T07
cctctcctccctcaccctctaccttacctcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 50915 - DNA, 353 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50916 - DNA, 395 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtgggcctggcacagcaccggcaacagccgctggacggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50917 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaataccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50918 - DNA, 417 bp, Artificial
  Mutation in BnaA.FAD2.a introduced by TALE nuclease pair BnFAD2_T07
cctctcctccctcaccctctcccttacctcggctggcctctctactgggcctgccagggctgcgtcctaaccggcgtctgggtcatagcccacgagtgcggtggtggcactgacgggtgccccgctcaacttgaccccggagcaggtgtcggccatcgtaccacgccttcagcgaccaccagcggctggacgccgccgtgggcctcgtcttccaccccttcctcctcgtcccttacttctcctggaagtacagacatcgacgccaccattccaacaccggatccctcgagagagacgaagtgtttgtccccaagaagaagtcagacatcaagtggtacggcaagtacctcaacaaccctttgggacgcacagggatgttaacggttcagttcactctcggctggcatttgtacttag

SEQ ID NO: 50919 - DNA, 346 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50920 - DNA, 282 bp, Artificial
  Mutation in BnaA.FAD2.a introduced by TALE nuclease pair BnFAD2_T07
cctctcctccctcaccctctctcctacacgctttcagcgactaccagtggctggacgacaccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttcggtcgcggctggcctgtgtacttag

SEQ ID NO: 50921 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaaatgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 50922 - DNA, 358 bp, Artificial
  Mutation in BnaA.FAD2.a introduced by TALE nuclease pair BnFAD2_T07
cctctcctccctcaccctctatcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagccatcgacgccaccagtccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50923 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgtgcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50924 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50925 - DNA, 376 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaaacaaaccaccgctcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50926 - DNA, 386 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgggttgcgtgagcgcatacgctacttgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50927 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttccgcgaccaccagtggctcgacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 50928 - DNA, 351 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccgtcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50929 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggcgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaaggacctcaacagccctttgggacgcgccgaggtgttagcgtctcagtgcactctgggcgggccgttgtacgtaa

SEQ ID NO: 50930 - DNA, 403 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccagcaatattggtggcaagcaggcgctggagacggtgcaggcgctgttgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50931 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcttctgggtcatagcccacgagtgcgactaccagtggttggacgacaccttcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50932 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50933 - DNA, 265 bp, Artificial
  Mutation in BnaA.FAD2.a introduced by TALE nuclease pair BnFAD2_T07
cctctcctccctcaccctctctcctacctcgcctggcctctctactgggcctgccaaggctgcgtcctaaccggcgtctgggtcatagcccacgagtgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50934 - DNA, 331 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50935 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtctgtcaagtaccccaccaacccattgggacgcaacatgatgttaacggttcagttcactctcggctggcctttgtacttag

SEQ ID NO: 50936 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50937 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50938 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50939 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccgtttggggcgcacagtgatgttaacggttcagttcactctcggctggcctttgtacttag

SEQ ID NO: 50940 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcgtctgggtcatagcccacgagtgcggaccacgccttcagcgactaccagtggcttgacgacaccgtcggcctcatcttccactccttcctcctcgtcccttacttctcctggaagtacagtcatcgacgccgccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50941 - DNA, 282 bp, Artificial
  Mutation in BnaA.FAD2.a introduced by TALE nuclease pair BnFAD2_T07
cctctcctccctcaccctctctccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50942 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcccaccacgccttcagcgaccaccagtggctggactacgccgtgggcctcgtcttccactccttcctcctcgtcccttacttctcctggaagtacagccatcgacgccaccgttccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50943 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50944 - DNA, 362 bp, Artificial; identical to SEQ ID NO: 46960
  Mutation in BnaA.FAD2.a introduced by TALE nuclease pair BnFAD2_T07

SEQ ID NO: 50945 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50946 - DNA, 343 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgtgatgaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50947 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 50948 - DNA, 258 bp, Artificial
  Mutation in BnaA.FAD2.a introduced by TALE nuclease pair BnFAD2_T07
cctctcccccctcaccctctctcctacttcgcctggcctctctactgggcctgccaaggctgcgtcctaacgggcctctgggtcatcgcccacgaatgcggcaccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50949 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50950 - DNA, 358 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgctaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50951 - DNA, 464 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccgtctccagcgcctgcttgccaccgccattgctggcgatggccaccacctgctggggggtcaagccgtgggcctggcacagcaccggcaacagccgctggaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacgaccctttgggacgcaccgtgatgttaacggttcagttcactctcggctggcctttgtacttag

SEQ ID NO: 50952 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaacaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50953 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggcgcgtcctaaccggcgtctgggtcatagcccacgagtgcggaccacgccttcagcgactaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50954 - DNA, 350 bp, Artificial
  Mutation in BnaA.FAD2.a introduced by TALE nuclease pair BnFAD2_T07
cctctcctccctcaccctctcccttacctctcctggcccctctactgggcctgccaaggctgcgtcctaacgggcctctgggtcatcgcccacgaatgcggccagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50955 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50956 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcatgtacctcaacaaccctttgggacgcgccgtgatgttaacggttcagttcactctcggctggcctttgtacttag

SEQ ID NO: 50957 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 50958 - DNA, 353 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgctccgtgatgttaacggttcagttcactctcggctggcctttgtacttag

SEQ ID NO: 50959 - DNA, 358 bp, Artificial
  Mutation in BnaA.FAD2.a introduced by TALE nuclease pair BnFAD2_T07
cctctcctccttcaccctctctcctacttcgcctggcctctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 50960 - DNA, 403 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccagcaatattggtggcaagcaggcgctggagacggtgcaggcgctgttgcccaccacgccttcagcgactaccagtggcttgacgacaccgtcggtctcatcttccacttcttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 50961 - DNA, 358 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcatcgtgatgttaacggttcagttcactctcggctggcctttgtacttag

SEQ ID NO: 50962 - DNA, 358 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50963 - DNA, 357 bp, Artificial; identical to SEQ ID NO: 46197
  Mutation in BnaA.FAD2.a introduced by TALE nuclease pair BnFAD2_T07

SEQ ID NO: 50964 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaaccctttgggacgcaccgtgatgttaacggttcagttcactctcggctggcctttgtacttag

SEQ ID NO: 50965 - DNA, 358 bp, Artificial; identical to SEQ ID NO: 46610
  Mutation in BnaA.FAD2.a introduced by TALE nuclease pair BnFAD2_T07

SEQ ID NO: 50966 - DNA, 298 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgtcttccactccttcctcctcgtcccttacttctcctggaagtacagtcatcgacgccaccattccaacactggctccctcgagagagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 50967 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50968 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50969 - DNA, 354 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtactta

SEQ ID NO: 50970 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50971 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50972 - DNA, 309 bp, Artificial
  Mutation in BnaA.FAD2.a introduced by TALE nuclease pair BnFAD2_T07
cctctcctccctcaccctctctcctacttcgcctggcctctctactgggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 50973 - DNA, 350 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50974 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50975 - DNA, 362 bp, Artificial
  Mutation in BnaA.FAD2.a introduced by TALE nuclease pair BnFAD2_T07
cctctcctccctcaccctctctcctacttcgcctggcccctctactgggcctgccagggctgcgtcctaaccggcgtctgggtcatagcccacgagtgcggccaaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50976 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgacgccttcagcgactaccagtggctggacgacaccgtcggcctcatcttccactccttcctcctcgtcccttacttctcctggaagtacagtcatcgacgccaccattccaacactggctccctcgagatggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50977 - DNA, 358 bp, Artificial
  Mutation in BnaA.FAD2.a introduced by TALE nuclease pair BnFAD2_T07
cctctcctccctcaccctctctactacttcgcctggcctctctactcagcctgccaaggctgcgtcctaaccggcgtctgggtcatagcccacgagtgcgaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcggctggcctttgtacttag

SEQ ID NO: 50978 - DNA, 358 bp, Artificial
  Mutation in BnaA.FAD2.a introduced by TALE nuclease pair BnFAD2_T07
cctctcctccctcaccctctctcctacttcgcctcacctcgctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacagtgagcttaacgtttcagttcactctcggctggcctttgtacttag

SEQ ID NO: 50979 - DNA, 367 bp, Artificial
  Mutation in BnaA.FAD2.a introduced by TALE nuclease pair BnFAD2_T07
cctctccttcctcaccctctctcctacttcgcctggcctctctactgggcctgccaaggctgcgtcctaaccggcgtctgggtcatagcccacgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50980 - DNA, 355 bp, Artificial
  Mutation in BnaA.FAD2.a introduced by TALE nuclease pair BnFAD2_T07
cctctccccctcaccctctctcctacttcgcctggcctctctactgggcctgccagggctgcgtcctaaccggcgtctgggtcatagcccacgagccaccacgccttcagcgactaccagtggctggacgacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50981 - DNA, 347 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgcgtcctaacaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50982 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgagcctctgggtcatcgcccacgaatgctaccacgccttcagcgaccaccagtggctggacgacgccgtgcgcctcgtcttccactccttcctcctcgtcccttacttcccctggaagtacagtcatcgacgccaccattccaacactggctccctcgagagagacgaagtgtttgtccccaagaagaagtcagacatcaagtggtacggcaagtacctcaacatccctttgggacgcaccgtgatgttaacggttcagttcactctcggctggcctttgtacttag

SEQ ID NO: 50983 - DNA, 358 bp, Artificial
  Mutation in BnaA.FAD2.a introduced by TALE nuclease pair BnFAD2_T07
cctctcctccctcaccctctcacttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50984 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50985 - DNA, 346 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 50986 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctaggtcatagcccacgagtgtgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 50987 - DNA, 358 bp, Artificial; identical to SEQ ID NO: 46631
  Mutation in BnaA.FAD2.a introduced by TALE nuclease pair BnFAD2_T07

SEQ ID NO: 50988 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgctaccacgccttcatcgaccaccagtggctggacgacgccgtgggcctcgtcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 50989 - DNA, 355 bp, Artificial
  Mutation in BnaA.FAD2.a introduced by TALE nuclease pair BnFAD2_T07
cctctcctccctcaccctctcccttacctcgcctggccactctactgggcctgccaagggtgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 50990 - DNA, 357 bp, Artificial; identical to SEQ ID NO: 46131
  Mutation in BnaA.FAD2.a introduced by TALE nuclease pair BnFAD2_T07

SEQ ID NO: 50991 - DNA, 357 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50992 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50993 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50994 - DNA, 358 bp, Artificial; identical to SEQ ID NO: 46485
  Mutation in BnaA.FAD2.a introduced by TALE nuclease pair BnFAD2_T07

SEQ ID NO: 50995 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacaccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 50996 - DNA, 355 bp, Artificial; identical to SEQ ID NO: 46640
  Mutation in BnaA.FAD2.a introduced by TALE nuclease pair BnFAD2_T07

SEQ ID NO: 50997 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 50998 - DNA, 354 bp, Artificial
  Mutation in BnaA.FAD2.a introduced by TALE nuclease pair BnFAD2_T07
cctctcctccctcaccctctccattacctcgcctggcccctctactgggcctgccaaggctgcgtcctaacgggcctctgggtcatcgcccacgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttggaacgcaccgtgatgttaacggttcagttcactctcggctggcctttgtacttag

SEQ ID NO: 50999 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcccaccacgccttctgcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51000 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51001 - DNA, 298 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51002 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 51003 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51004 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcgcaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51005 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctttgggacgcaccgtgatgttaacggttcagttcactctcggctggcctttgtacttag

SEQ ID NO: 51006 - DNA, 364 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaactggcctctgggtcatcgcccacgaatgcgggggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51007 - DNA, 363 bp, Artificial; identical to SEQ ID NO: 47355
  Mutation in BnaA.FAD2.a introduced by TALE nuclease pair BnFAD2_T07

SEQ ID NO: 51008 - DNA, 365 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 51009 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51010 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgcctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51011 - DNA, 258 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcggcaccaccattccaacaccggatccctcgagagggatgaagtgttcgtccccaagaagaagtcagacatcaagtggtacggcaagtacctcaacaaccctttgggacgcaccgtgatgttaacggttcagttcacgctcggctggcctttgtacttag

SEQ ID NO: 51012 - DNA, 357 bp, Artificial
  Mutation in BnaA.FAD2.a introduced by TALE nuclease pair BnFAD2_T07
ccctcctccctcaccctctctcctacttcgcctggcctctctactgggcctgccaagggtgcgtcctaacgggcctctgggtcatcgtccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51013 - DNA, 358 bp, Artificial
  Mutation in BnaA.FAD2.a introduced by TALE nuclease pair BnFAD2_T07
cctcttctccctcaccctctctcctacttcgcctggcctctctactgggcctgccaaggctgcgtcctaacgggcctctgggtcatcgcccacgaatgctaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51014 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttctgttcactctcggctggcctttgtacttag

SEQ ID NO: 51015 - DNA, 360 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcggcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51016 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 51017 - DNA, 386 bp, Artificial
  Mutation in BnaA.FAD2.a introduced by TALE nuclease pair BnFAD2_T07
cctctcctccctcaccctctcccttacctcgcctggccactctactgggcctgccaaggctgcgtcctaacgcgcctctgggtcaccgcccacgaatgcgatcgagatcgcccggaacagcacccaccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaccacctcttaggggcgcaccgtgatgttaacggttcagttcactctcggctggcctttgtacttag

SEQ ID NO: 51018 - DNA, 351 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcataaccggcgtctgggtcatagcccaccgtcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51019 - DNA, 340 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51020 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51021 - DNA, 282 bp, Artificial
  Mutation in BnaA.FAD2.a introduced by TALE nuclease pair BnFAD2_T07
cctctcctccctcaccctctctcctacacgctttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51022 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51023 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51024 - DNA, 343 bp, Artificial
  Mutation in BnaA.FAD2.a introduced by TALE nuclease pair BnFAD2_T07
cctctcctccctcaccctttctcctacttcgcctggcctctctactgggcctgccagggctgcgtcctaaccggcgtctgggtcatagcccacgagtgcgactaccagtggttggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctagaacgcacggtgatgctaaccgtccaggtcacgctcggctggcctttgtacttag

SEQ ID NO: 51025 - DNA, 356 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaacaccacgccttcagcgaccaccagtggctggacgacgccgtgggcctcgtattccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttagc

SEQ ID NO: 51026 - DNA, 360 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcggcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaattacctcaacaaccctttgggacgcaccgtgatgttaacggttcagttcactctcggctggcctttgtacttag

SEQ ID NO: 51027 - DNA, 355 bp, Artificial
  Mutation in BnaA.FAD2.a introduced by TALE nuclease pair BnFAD2_T07
cctctcctccctcaccctctctcctacttcgcctggcctctctactcggcctgccagggctgcgtcctaaccggcgcctgggtcatagcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaaccagctaggacgcagggtgattctaacggttcagttcactctcggctggcctttgtacttag

SEQ ID NO: 51028 - DNA, 362 bp, Artificial; identical to SEQ ID NO: 48084
  Mutation in BnaA.FAD2.a introduced by TALE nuclease pair BnFAD2_T07

SEQ ID NO: 51029 - DNA, 358 bp, Artificial; identical to SEQ ID NO: 47570
  Mutation in BnaA.FAD2.a introduced by TALE nuclease pair BnFAD2_T07

SEQ ID NO: 51030 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51031 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccgacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51032 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaataccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttaactctcggctggcctttgtacttag

SEQ ID NO: 51033 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 51034 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtatgggtcatagcccacgagtgtgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtaactcaacaacccgctaggacgcacggtgatgctaaccgtccagttcacgctcggctggcctttgtacttag

SEQ ID NO: 51035 - DNA, 346 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51036 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggccaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51037 - DNA, 358 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51038 - DNA, 364 bp, Artificial
  Mutation in BnaA.FAD2.a introduced by TALE nuclease pair BnFAD2_T07
cctctcctccctcaccctctcccttacctcgtctggcccctctactgggcctgccaaggctgcgccctaacgggcctctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtcccccaacacccctgtggggcacaccgtgatgttaacggttccgctccctctcggctggcctttgtacttag

SEQ ID NO: 51039 - DNA, 355 bp, Artificial
  Mutation in BnaA.FAD2.a introduced by TALE nuclease pair BnFAD2_T07
cctctcctccctcaccctctctcctacttcgcctggcctctctactcggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaggtacctcagcaaccctgtgggacgccccgtgatgttaacggttcagttcacgctcggctggccttagcacttag

SEQ ID NO: 51040 - DNA, 361 bp, Artificial
  Mutation in BnaA.FAD2.a introduced by TALE nuclease pair BnFAD2_T07
cctctcctccctcaccctctctcctacttcctctcgccccctaacagggcctgcccaagctgcgccctaacgtctttctctcccttagcccccgccctcggctaccacggcatcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51041 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagtcatcgacgccaccattccaacactggctccatcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51042 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacacaccgtgatgttaacggttcagttcactctcggctggcctttgtacttag

SEQ ID NO: 51043 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51044 - DNA, 357 bp, Artificial
  Mutation in BnaA.FAD2.a introduced by TALE nuclease pair BnFAD2_T07
ccttcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51045 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagcggctccacgacaccgtcggcctcatcttccactccttcctcctcgtcccttacttctcctggaagtacagtcatcgacgccaccattccaacactggctccctcgagagagacgaagtgttcgtccccaataagaagccagacatgacgtggtacggcaggtacctcagcatgcctccgagacgcaccgtggtgttaacggttcagttcacgctccgctggccttagtgcttag

SEQ ID NO: 51046 - DNA, 258 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcggcaccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51047 - DNA, 451 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacggtccagcggctgttgccggtgctgtgccaggcccacggcttgaccccggagcaggtggtggccatcgccagccacgatggcggcaagcaggcgctggagacggtccagcggctgttgccccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51048 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51049 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51050 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggttatagcccacgagtgcggcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51051 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcggttcactctcggctggcctttgtacttag

SEQ ID NO: 51052 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51053 - DNA, 357 bp, Artificial; identical to SEQ ID NO: 46379
  Mutation in BnaA.FAD2.a introduced by TALE nuclease pair BnFAD2_T07

SEQ ID NO: 51054 - DNA, 451 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacggtccagcggctgttgccggtgctgtgccaggcccacggcttgaccccggagcaggtggtggccatcgccagccacgatggcggcaagcaggcgctggagacggtccagcggctgttgccccaccacgccttcagcgaccaccagtggctggaagacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51055 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacaacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51056 - DNA, 426 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcctccagcgcctgcttgccgccatcgtggctggcggctgttgccggtgctgtgccaggcccacggcttgaccccggagccaccacgccttcagcgactaccagtggcttgacgacaccgtcggtctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 51057 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51058 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 51059 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51060 - DNA, 367 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccgccgtctgggtcatcgcccacgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 51061 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51062 - DNA, 331 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatggctggacgacgccgtgggcctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51063 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttccccctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51064 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51065 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcacgccttcagcgactaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51066 - DNA, 340 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 51067 - DNA, 265 bp, Artificial
  Mutation in BnaA.FAD2.a introduced by TALE nuclease pair BnFAD2_T07
cctctcctccctcaccctctctcctacttcgcctggcctctctaccgggcctgccagggccgcttcctacccggcgtctgggtcatagcccacgagtgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51068 - DNA, 358 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51069 - DNA, 329 bp, Artificial
  Mutation in BnaA.FAD2.a introduced by TALE nuclease pair BnFAD2_T07
cctctcctccctccctctcccttacctcgcctggcccctctactgggcctgccaaggctgcgtcctaacgggcctctgggtcatcgcccacgaatggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcagcgtgatgttaacggttcagttcactctcggctggccgttgtacttag

SEQ ID NO: 51070 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcgggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51071 - DNA, 356 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtgaccacgccttcagcgactaccagtggctggacgacaccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51072 - DNA, 358 bp, Artificial; identical to SEQ ID NO: 46083
  Mutation in BnaA.FAD2.a introduced by TALE nuclease pair BnFAD2_T07

SEQ ID NO: 51073 - DNA, 364 bp, Artificial; identical to SEQ ID NO: 47535
  Mutation in BnaA.FAD2.a introduced by TALE nuclease pair BnFAD2_T07

SEQ ID NO: 51074 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51075 - DNA, 442 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtttggaccgtctccagcgcctgcttgccgccatcgtggctggcgatggccaccacctgctccggggtcaagccgtgggcctggcagccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51076 - DNA, 358 bp, Artificial; identical to SEQ ID NO: 47410
  Mutation in BnaA.FAD2.a introduced by TALE nuclease pair BnFAD2_T07

SEQ ID NO: 51077 - DNA, 362 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcggctcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51078 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcaccacgccttcagcgactaccagtggcttgacgacaccgtcggtctcatcttccactccttcctcctcgtcccttacttctcctgaaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51079 - DNA, 465 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcctctgggtcatcgcccacgaatgcgtgtccagcgcctgcttgccgccatcgtggctggcgatggccaccacctgctccggggttaagccgtgggcctggcacagcaccggcaacagccgctggaccgtctccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51080 - DNA, 342 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccgccgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacgccaagtacctcaccaaccctgttggacgcaacgtgatgttaacggttcatttcactctcggctggcctttgtacttag

SEQ ID NO: 51081 - DNA, 358 bp, Artificial; identical to SEQ ID NO: 46298
  Mutation in BnaA.FAD2.a introduced by TALE nuclease pair BnFAD2_T07

SEQ ID NO: 51082 - DNA, 358 bp, Artificial
  Mutation in BnaA.FAD2.a introduced by TALE nuclease pair BnFAD2_T07
cctctcctccctcaccctctcccttacctcgccttgcccctctactgggcctgccacggctgcgtcctaacgggcctctgggtcatcgcccacgaatgccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 51083 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51084 - DNA, 346 bp, Artificial
  Mutation in BnaA.FAD2.a introduced by TALE nuclease pair BnFAD2_T07
cctctcctctctcaccctctcccttacctcgcctggcccctctactgggcctgccaaggctgcgtcctaacgggcgtctgggtcatagcctacgccttcagcgactaccagtggcttgacgacaccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagtgcactctcggctggcctttgtacttaa

SEQ ID NO: 51085 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgaccaccagtggctggacgacgccgtgggcctcgtcttccactccttcctcctagtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51086 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51087 - DNA, 357 bp, Artificial; identical to SEQ ID NO: 46895
  Mutation in BnaA.FAD2.a introduced by TALE nuclease pair BnFAD2_T07

SEQ ID NO: 51088 - DNA, 367 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgtctgggtcatagcccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51089 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctcacgggcctctgggtcatcgcccacgaataccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcagcatccgttggggacgcgccgtggtgttaacggttcagttcactcgcggctggccttagtacttag

SEQ ID NO: 51090 - DNA, 340 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcaacgccttcagcgactaccagtggctggacgacaccgtcggcctcatcttccactccttcctcctcgtcccttacttctcctggaagtacagtcatcgacgccaccattccaacactggctccctcgagagaaacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51091 - DNA, 355 bp, Artificial
  Mutation in BnaA.FAD2.a introduced by TALE nuclease pair BnFAD2_T07
cctctcctccctcaccctctctcctacttcgcctgtcctctctactgggcctgccaagggtgcgtcctaaccggcgtctgggtcatagcccacgagtaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacgtag

SEQ ID NO: 51092 - DNA, 406 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggagcggatttgaacgttgtgaagcaacggcccggagggtggcgggcgtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctgtgtacttag

SEQ ID NO: 51093 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagaaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51094 - DNA, 395 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgcgcctggcacagcaccggcaacagccgctggaccgccaccaggccttcagcgactaccagtggcctgaccacgccgttggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51095 - DNA, 357 bp, Artificial
  Mutation in BnaA.FAD2.a introduced by TALE nuclease pair BnFAD2_T07
cctctcctcctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51096 - DNA, 446 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcggcggtggcaagcaggcgctggagacggtccagcggctgttgccggggctgtgccaggcccacggcttgaccccggagcagggggtgccaccacgccttcagcggccaccagtggctggacgacgccgtgggcctcgtcttccactccatcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51097 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtgcttag

SEQ ID NO: 51098 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 51099 - DNA, 365 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcatttcactcgcggctggcctgtatacttag

SEQ ID NO: 51100 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacattcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51101 - DNA, 359 bp, Artificial
  Mutation in BnaA.FAD2.a introduced by TALE nuclease pair BnFAD2_T07
cctctcctccctcaccctctcacttacctcgcctggcccctctactgggcctgccaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggtgcagttcactctcggctggcctttgtacttag

SEQ ID NO: 51102 - DNA, 362 bp, Artificial; identical to SEQ ID NO: 46503
  Mutation in BnaA.FAD2.a introduced by TALE nuclease pair BnFAD2_T07

SEQ ID NO: 51103 - DNA, 367 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcaggcatcaagtggtacggcaagtacctcaacaaccctttgggacgcaccgtgatgttaacggttcagttcactctcggctggcctttgtacttag

SEQ ID NO: 51104 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51105 - DNA, 357 bp, Artificial
  Mutation in BnaA.FAD2.a introduced by TALE nuclease pair BnFAD2_T07
cctctcctccctcaccctctcacctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 51106 - DNA, 343 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcgtctgggtcatcgcccacgaatgcggccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggcccggcaagtaccccaacaaccctttgggacgcaccgggatgttaacggttcagttcactctcggctggcctgtgtacttag

SEQ ID NO: 51107 - DNA, 360 bp, Artificial
  Mutation in BnaA.FAD2.a introduced by TALE nuclease pair BnFAD2_T07
cctctcctccctcaccctctttcctacttcgcctggcctctctactgggcctgccaagggtgcgtcctaaccggcgtctgggtcatagcccacgagtgcggcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcacgtggtacggcaagtacctcaacaaccctttgggacgcgccgggatggtaacggttccgttcactctcggcgggcctttgtgcttag

SEQ ID NO: 51108 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51109 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51110 - DNA, 357 bp, Artificial
  Mutation in BnaA.FAD2.a introduced by TALE nuclease pair BnFAD2_T07
cctctcctccctcaccctctcccttacctcgcctgccccctctactgggcctgccaaggctgcgtcctcacgggcctctgggtcatcgcccacgaatgcaccacgccttcagctaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 51111 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51112 - DNA, 367 bp, Artificial
  Mutation in BnaA.FAD2.a introduced by TALE nuclease pair BnFAD2_T07
cctctcctccctcaccctctctcctacttcgcctggcctctctacttggcctgccagggctgcgtcctaaccggcgtctgggtcatagcccacgtctgggtcatagcccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51113 - DNA, 362 bp, Artificial
  Mutation in BnaA.FAD2.a introduced by TALE nuclease pair BnFAD2_T07
cctctcctccctcaccctctatcctacttcgcctggcctctctactgggcctgccagggctgcgtcctaaccggcgtctgggtcatagcccacgagtgcggcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtgcctcaacaaccctttgggacgcaccgtgatgttaacggttcagttcactctcggctggcctttgtacttag

SEQ ID NO: 51114 - DNA, 358 bp, Artificial; identical to SEQ ID NO: 46402
  Mutation in BnaA.FAD2.a introduced by TALE nuclease pair BnFAD2_T07

SEQ ID NO: 51115 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51116 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51117 - DNA, 362 bp, Artificial; identical to SEQ ID NO: 46137
  Mutation in BnaA.FAD2.a introduced by TALE nuclease pair BnFAD2_T07

SEQ ID NO: 51118 - DNA, 344 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggctaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51119 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51120 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51121 - DNA, 365 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51122 - DNA, 359 bp, Artificial
  Mutation in BnaA.FAD2.a introduced by TALE nuclease pair BnFAD2_T07
cctctcctccctcaccctctctcctacttcgcctggcctctctactgtgcctgccagggctgcgtcctaaccggcgtctgggtcatagcccacgagtgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaacccttatggacgcaccgtgatgttaacggttcatctccctctcggctggcctttgtacttag

SEQ ID NO: 51123 - DNA, 349 bp, Artificial
  Mutation in BnaA.FAD2.a introduced by TALE nuclease pair BnFAD2_T07
cctctcctccctcaccctctcccttacctctcctggcccctctactgggcctgccaaggctgcgtcctaacgggcctctgggtcatcgcccacgaatgcggccagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 51124 - DNA, 347 bp, Artificial
  Mutation in BnaA.FAD2.a introduced by TALE nuclease pair BnFAD2_T07
cctctcctccctcaccctctaccttacctcgcctggcccctctactgggcctgccaaggctgcgtcctaacgggcctctgcgtcctaacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51125 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtacgccttcagcgactaccagtggctggacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51126 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcccaccacgccttcagcgaccaccagtggctggacgacgccgtgggcctcgtcttccactcattcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51127 - DNA, 390 bp, Artificial
  Mutation in BnaA.FAD2.a introduced by TALE nuclease pair BnFAD2_T07
cctcttctccctcaccctctctcctacttcgcctggaatctctactgggcctgccagggctgcgtcctaaccggcgtctgggtcatagcccacgagtgcggacaatggtgacttctacagcgcggagaatcttccactccttcagcgactaccagtggctggacgacaccgtcggcctcatcttccactccttcctcctcgtcccttacttctcctggaagtacagtcatcgacgccaccattccaacactggctccctagagagagacgaagtgtgtgtccccaagaagaagtcagacatcaagtggtacggcaagtacctcaacaaccctttgggacgcaccttgatgttaacggttcagttcactctcggctggcctttgtacttag

SEQ ID NO: 51128 - DNA, 354 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51129 - DNA, 349 bp, Artificial
  Mutation in BnaA.FAD2.a introduced by TALE nuclease pair BnFAD2_T07
cctctcctccatcaccctctcccttacctcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51130 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctactggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51131 - DNA, 299 bp, Artificial
  Mutation in BnaA.FAD2.a introduced by TALE nuclease pair BnFAD2_T07
cctctcctccctcaccctctctcctacttcgcctggcctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51132 - DNA, 342 bp, Artificial
  Mutation in BnaA.FAD2.a introduced by TALE nuclease pair BnFAD2_T07
cctctcctccctcaccctctctcctacttcgcctggcctctctactgcgcctgccaagggcgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttatcggttcagttctctcgtggctggcctttgtacgtag

SEQ ID NO: 51133 - DNA, 350 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51134 - DNA, 358 bp, Artificial; identical to SEQ ID NO: 46227
  Mutation in BnaA.FAD2.a introduced by TALE nuclease pair BnFAD2_T07

SEQ ID NO: 51135 - DNA, 359 bp, Artificial
  Mutation in BnaA.FAD2.a introduced by TALE nuclease pair BnFAD2_T07
cctctcctccctcaccctctatcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51136 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgcattcagcgactaccagtggcttgacgacaccgtcggtctcatcttccactccttcctcctcgtcccttacttctcctggaagtacagtcatcgacgccaccattcaaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51137 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51138 - DNA, 331 bp, Artificial
  Mutation in BnaA.FAD2.a introduced by TALE nuclease pair BnFAD2_T07
cctctcctccctcaccctctcccttacctcgcctggcccatctactgggcctgccaaggctgcgtcctaacgggcctctgggtcatcgcccacgaatggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51139 - DNA, 258 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaccaccattccaacactggctccctcgagagagacgaagtgtttgtccccaagaagaagtcagacatcaagtggtacggcaagtacctcaacaaacctttgggacgcaccgtgatgttaacggttcagttcactctcggctggcctttgtacttag

SEQ ID NO: 51140 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttatcggttcagttctctctcggcgggccgttgtacttag

SEQ ID NO: 51141 - DNA, 265 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51142 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacactttgggacgcaccgtgatgttaacggttcagttcactctcggctggcctttgtacttag

SEQ ID NO: 51143 - DNA, 357 bp, Artificial
  Mutation in BnaA.FAD2.a introduced by TALE nuclease pair BnFAD2_T07
cctctcctccctcaccctctcccctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51144 - DNA, 355 bp, Artificial; identical to SEQ ID NO: 46641
  Mutation in BnaA.FAD2.a introduced by TALE nuclease pair BnFAD2_T07

SEQ ID NO: 51145 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccaccacggcttccgcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51146 - DNA, 345 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgattcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51147 - DNA, 401 bp, Artificial
  Mutation in BnaA.FAD2.a introduced by TALE nuclease pair BnFAD2_T07
cctctcctccctcaccctctctcctacttcgcctggcctctctactgggcctggtgccaggcccacggcttgaccccggagcaggtggtggccatcgccagccacgatggcggcaagcaggcgctggagacggtccagcggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51148 - DNA, 357 bp, Artificial
  Mutation in BnaA.FAD2.a introduced by TALE nuclease pair BnFAD2_T07
cctctccccctcaccctctctcctacttcgcctggcctctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctgtgtacttag

SEQ ID NO: 51149 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcctctgggtcatcgcccacgaatgccaccacgccttcagcgaccaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51150 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtaatagcccaaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51151 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 51152 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51153 - DNA, 386 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgatcgagatcgcccggaacagcacccaccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51154 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtccctcaacacccctttgggacgcaccgtgatgttaacggttccgttcactctcggctggcctttgtacttag

SEQ ID NO: 51155 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51156 - DNA, 282 bp, Artificial
  Mutation in BnaA.FAD2.a introduced by TALE nuclease pair BnFAD2_T07
cctctcctccctcaccctctctcctacacgctttcagcgactaccagtggctggacgacaccgtcggcctcatcttccactccttcctcctcgtcccttacttctcttggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51157 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaaccggcgtctgggtcatagcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51158 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacgccaagtacctcaacaaccctttgggacgcaccgtgatgttaccggttcagttcactctcggctggcctttgtacttag

SEQ ID NO: 51159 - DNA, 355 bp, Artificial; identical to SEQ ID NO: 46110
  Mutation in BnaA.FAD2.a introduced by TALE nuclease pair BnFAD2_T07

SEQ ID NO: 51160 - DNA, 360 bp, Artificial
  Mutation in BnaA.FAD2.a introduced by TALE nuclease pair BnFAD2_T07
cctctcctccctcaccctctctcctacttcgcctggaccctctactgggcctgccaagggtgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatcttaacggttcagttcactctcggctggcctttgtacttag

SEQ ID NO: 51161 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51162 - DNA, 357 bp, Artificial
  Mutation in BnaA.FAD2.a introduced by TALE nuclease pair BnFAD2_T07
cctctcctccctcaccctctctcctacttcgcctggcccctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgcaaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51163 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaacccttggggacgcaccgtgatgtgaacggttcagttcactcgcggctggccttcgtacttag

SEQ ID NO: 51164 - DNA, 358 bp, Artificial
  Mutation in BnaA.FAD2.a introduced by TALE nuclease pair BnFAD2_T07
cctctcctccctcaccctctgccttacctcgcctggcccctctactgggcctgccaaggctgcgccctaacgggcctctgcgtcatcgcccacgaatgtccccacgccttcagcgaccaccagtggctggacgacgccgttggcctcgtcttccactccttcctcctcgtcccttacttctcctggaagtacaatcatcgacgccaccattccaacactggctccctcgagagagacgaagtgtttgtccccaagaagaagtcagacatcaagtggtacggcaagtacctcaacaaccctttgggacgcagcgtgatgttaacggttcagttcaggctaggatgccattagtacttag

SEQ ID NO: 51165 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaaccggcgtctgggtcatcgcccacgagtgccaccacgccttcagcgactaccagtggctcgacgacaccgtcggcctcatcttccactccttcctcctcgtcccttacttctcctggaagtacagtcatcgacgccaccattccaacactggctccctcgagagagacgaagtgtttgtccacaagaagaagtcagacatcaagtggtacggcaagtacctcaacaaccctttgggacgcaccgtgatgttaacggttcagttcacgctcggctggcctttgtacttag

SEQ ID NO: 51166 - DNA, 364 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51167 - DNA, 358 bp, Artificial
  Mutation in BnaA.FAD2.a introduced by TALE nuclease pair BnFAD2_T07
cctctcctccctcaccctctcccttacctcgcctggaccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctttgtacttag

SEQ ID NO: 51168 - DNA, 365 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccggccaccacgccttcagcgaccaccagtggctggacgacgccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51169 - DNA, 356 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttttggacgcaccgtgatgttaacggttcagttcactctcggctggcctttgtacttag

SEQ ID NO: 51170 - DNA, 367 bp, Artificial
  Mutation in BnaA.FAD2.a introduced by TALE nuclease pair BnFAD2_T07
cctctcctccctcaccctctctcctacttcgcctggcctctctactgggcctgccagggctgcgtccaaaccggcgtctgggtcataggccacgtctgggtcatagcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctaaacaacactttgggacgcaccgtgatggtaacggttcagttcactctcggctggcctttgtacgtag

SEQ ID NO: 51171 - DNA, 462 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgccgccatcgtggctggcgatggccaccacctgctccggggtcaagccgtgggcctggcacagcaccggcaacagccgctggaccgtctccagcgcctgcttgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgttgggacgcaccgtgatgttaacggttcagttcactcgcggctggcctttgtacttag

SEQ ID NO: 51172 - DNA, 325 bp, Artificial
  Mutation in BnaA.FAD2.a introduced by TALE nuclease pair BnFAD2_T07
cctctcctccctcaccctgtctcctacttcgcctggcctctctactgggcctgccagggctgcgtctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51173 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactctttcctcctcgtcccttacttctcctggaagtacagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 51174 - DNA, 343 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcgatgaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 51175 - DNA, 361 bp, Artificial
  Mutation in BnaA.FAD2.a introduced by TALE nuclease pair BnFAD2_T07
ctcctccctcaccctctctcctacttcgcctggcctctctactgggcctgccagggctgcgtcctaaccggcgtctgggtcatagcccacgagtgcggtcggccaccacgccttcagcgaccaccagtggctggacgacgccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtactag

SEQ ID NO: 51176 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctgtgggacgcaccgtgatgttaccggttcagttcactctcggctggcctttgtacttag

SEQ ID NO: 51177 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51178 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51179 - DNA, 359 bp, Artificial; identical to SEQ ID NO: 46512
  Mutation in BnaA.FAD2.a introduced by TALE nuclease pair BnFAD2_T07

SEQ ID NO: 51180 - DNA, 349 bp, Artificial
  Mutation in BnaA.FAD2.a introduced by TALE nuclease pair BnFAD2_T07
cctctcctccctcaccctctctactacttcgcctggcctctctactgggcctgccagggctgcgtcctaaccggcgtctgggtcatagcccacgaggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51181 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtggccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51182 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgactaccagtggttggacgacaccttcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51183 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctctgctggcctttgtacttag

SEQ ID NO: 51184 - DNA, 357 bp, Artificial
  Mutation in BnaA.FAD2.a introduced by TALE nuclease pair BnFAD2_T07
cctctcctccctcaccctgtctcctacttcgcctggcctctctactgcgcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtaccgcaacaacccgctaggactcagggagaggctaagcggcgagtgcactcgcgggtggcatgtgtacttag

SEQ ID NO: 51185 - DNA, 355 bp, Artificial
  Mutation in BnaA.FAD2.a introduced by TALE nuclease pair BnFAD2_T07
cctctcctccctcaccctctcccttacctcgcctgtcccctctactgggcctgccaaggctgcgtcctaacgggcctctgggtcatcgcccacgaataccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccgtgtgggaggcaccgtgaggttaacggttcagttcactctcggctggcctttgtacttag

SEQ ID NO: 51186 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcactacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgtaccgtgatgttaccggttcagttcactctcggctggcctttgtacttag

SEQ ID NO: 51187 - DNA, 356 bp, Artificial; identical to SEQ ID NO: 46140
  Mutation in BnaA.FAD2.a introduced by TALE nuclease pair BnFAD2_T07

SEQ ID NO: 51188 - DNA, 298 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51189 - DNA, 258 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcggcaccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51190 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgggccaccacgccttcagcgactaccagtggctggacgccaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51191 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatcgcccacgaatgctaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51192 - DNA, 298 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgtcttccactccttcctcctcgtcccttacttctcctggaagtacagtcatcgacgccaccattccaacactggctccctcgagagagacggagtgtttgtccccaagaagaagtcagacatcaagtggtacggcaagtacctcaacaaccctttgggacgcaccgtgatgttaacggttcagttcactctcggctggcctttgtacttag

SEQ ID NO: 51193 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 51194 - DNA, 356 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51195 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51196 - DNA, 352 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaaccggcgtctgggtcatagcccacgagtgtgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 51197 - DNA, 282 bp, Artificial
  Mutation in BnaA.FAD2.a introduced by TALE nuclease pair BnFAD2_T07
cctctcctccctcaccctctctcctacacgctttcagagactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51198 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51199 - DNA, 358 bp, Artificial
  Mutation in BnaA.FAD2.a introduced by TALE nuclease pair BnFAD2_T07
cctctcctccctcaccctctccattacctcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51200 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51201 - DNA, 361 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagtcatcgacgccaccattccaacactggctccctcgatagagacgaagtgtttgtccccaagaagaagtcagacatcaagtggtacggcaagtacctcaacaaccctttgggacgcaccgtgatgttaacggttcagttcactctcggctggccttgtacttag

SEQ ID NO: 51202 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagtgtgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagttgtacggcaagtacctcaacaaccctttgggacgcaccgtgatgctaacggttcagttcactctcggctggcctttgtacttag

SEQ ID NO: 51203 - DNA, 360 bp, Artificial
  Mutation in BnaA.FAD2.a introduced by TALE nuclease pair BnFAD2_T07
cctctcctccctcaccctctcccttacctcgtctggcacctctactgggcctgccaaggctgcgtcctaacgggcctctgggtcatcgcccacgaatgcgccaccacgccttcagcgaccaccagtggctggacgacaccgtcggcctcatcttccactccttcctcctcgtcccttacttctcctggaagtacagtcatcgacgccaccattccaacactggctccctcgagagagaggaagggtttgtagccaagaagaagtcggagaacgagtggtacggcgagtagcggaagacgccggtggggcgcacggggatgttaacggttcagttcactctcggctggccgttgtacgtag

SEQ ID NO: 51204 - DNA, 360 bp, Artificial
  Mutation in BnaA.FAD2.a introduced by TALE nuclease pair BnFAD2_T07
cctctcctccctcaccctctctcctacttcgcctggcatctctactgggcctgccagggctgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51205 - DNA, 358 bp, Artificial
  Mutation in BnaA.FAD2.a introduced by TALE nuclease pair BnFAD2_T07
cctctcctccctcaccctctcacttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51206 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51207 - DNA, 352 bp, Artificial
  Mutation in BnaA.FAD2.a introduced by TALE nuclease pair BnFAD2_T07
cctctcctccctcaccctctcccttacctcgcctggcctctctactgggcctgccaagggtgcgtcctaaccggcgtctgggtcatagcccacgagtgcgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51208 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcacgccttcagcgactaccagtggctggacgacaccgtcggcctcatcttccactccttcctcctcgtcccttacttctcctggaagtacagtcatcgacgccaccattccaacactggctccctcgagagagaagaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51209 - DNA, 309 bp, Artificial
  Mutation in BnaA.FAD2.a introduced by TALE nuclease pair BnFAD2_T07
cctctcctccctcaccctctcccttacctcgcctggcctctctactgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51210 - DNA, 359 bp, Artificial
  Mutation in BnaA.FAD2.a introduced by TALE nuclease pair BnFAD2_T07
cctctcctccctcaccctctctcctacttcgcctggcctctctactgggcctcccagggctgcgtcctaaccggcgtctgggtcatagcccacgagtgcgtaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtaccccaacaacccgcaaggacgcacgatgatgctaaccgtcccgttcacgctcggctggcctttgtacttag

SEQ ID NO: 51211 - DNA, 355 bp, Artificial
  Mutation in BnaA.FAD2.a introduced by TALE nuclease pair BnFAD2_T07
cctctgctccctcaccctctctcctacttcgcctggcctctctactgggcctgccaggggtgcgtcctaaccggcgtctgggtcatagcccacgagtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 51212 - DNA, 348 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgctaccacgacttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51213 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51214 - DNA, 364 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 51215 - DNA, 298 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51216 - DNA, 357 bp, Artificial; identical to SEQ ID NO: 46519
  Mutation in BnaA.FAD2.a introduced by TALE nuclease pair BnFAD2_T07

SEQ ID NO: 51217 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51218 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccctcagcgactaccagtggctggacgacgccgtcggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51219 - DNA, 417 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggtggtggcactgacgggtgccccgctcaacttgaccccccagcaggtggtggccatcgtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51220 - DNA, 406 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggagcggatttgaacgttgtgaagcaacggcccggagggtggcgggcgtaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51221 - DNA, 363 bp, Artificial
  Mutation in BnaA.FAD2.a introduced by TALE nuclease pair BnFAD2_T07
cctctcctccctcaccctctctcctacttcgcctggcctctctactcggcctgccagggctgcgtcctaaccggcgtctgggtcatagcccacgagtgcgggcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 51222 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51223 - DNA, 357 bp, Artificial
  Mutation in BnaA.FAD2.a introduced by TALE nuclease pair BnFAD2_T07
cctctcctccctcaccctctctcctacttcgcctggcctctctactcggcctgccaagggtgcgtcctaaccggcgtctgggtcatagcacacgagtgcaccacgccttcaacgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtccggcaattacctcaccaagcctgttggacgcaacgtgatgtcaaccgttccgttcactctcggctggcctttgtacttag

SEQ ID NO: 51224 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaatgcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51225 - DNA, 346 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51226 - DNA, 355 bp, Artificial
  Mutation in BnaA.FAD2.a introduced by TALE nuclease pair BnFAD2_T07
cctctcctccctcaccctctcccttacctcgtctggcccctctactgggcctgccaaggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51227 - DNA, 365 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggtcggccaccacgccttcagcgactaccagtggctggacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51228 - DNA, 362 bp, Artificial; identical to SEQ ID NO: 46321
  Mutation in BnaA.FAD2.a introduced by TALE nuclease pair BnFAD2_T07

SEQ ID NO: 51229 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcacgctcggctggcctttgtacttag

SEQ ID NO: 51230 - DNA, 359 bp, Artificial
  Mutation in BnaA.FAD2.a introduced by TALE nuclease pair BnFAD2_T07
cctctcctccctcaccctctcccttacctcgcctggcccctctactgtgcctgccaaggctgcgtcctaacgggcctctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51231 - DNA, 347 bp, Artificial
  Mutation in BnaA.FAD2.a introduced by TALE nuclease pair BnFAD2_T07
cctctcctccctcaccctctcccttacctcgcctggcccctctactggtcctgccaaggctgcgtcctaacgggcctctgggtcatcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51232 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacaccgtcggcctcatcttccactccttcctcctcgtcccttacttctcctggaagtacagccatctacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51233 - DNA, 353 bp, Artificial
  Mutation in BnaA.FAD2.a introduced by TALE nuclease pair BnFAD2_T07
cctctcctccctcaccctctccattacctcgcctggcccctctactgggcctgccaaggctgcgtcctaaccggcgtctgggtcatagcccacgagtgacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51234 - DNA, 353 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgccatcaagtggtacggaaagtacctcaacaacccgccaggacgcacggtgatgctaaccgtccaggtcacgctcggctggcctttgtacttag

SEQ ID NO: 51235 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 51236 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaaccacgccttcagcgactaccagttgcttgacgacaccgtcgatctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcagttcacgctcggctggcctttgtacttag

SEQ ID NO: 51237 - DNA, 357 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51238 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtaccacgccttcagcgactaccagtggctggacgacaccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttgggacgcaccgtgatggtaacggttcagttcactctcggctggcctttgtacttag

SEQ ID NO: 51239 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgcgaggacgcacggtgatgctaaccgtccagttcacgctcggctggcctttgtacttag

SEQ ID NO: 51240 - DNA, 352 bp, Artificial
  Mutation in BnaA.FAD2.a introduced by TALE nuclease pair BnFAD2_T07
cctctcctccctcaccctctctcctacttcgcctggcctatctactgggcctgccagggctgcgtcctaatcggcgtctaggtcatagcccacgagtgtgccttcagcgactaccagtggctggacgacaccgtcggcctcatcttccactccttcctcctcgtcccttacttctactggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51241 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51242 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggccaaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51243 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggcaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacacccctgtgggacgcaccgtgatgttaacggttcagtccactctcggctggcctttgtacttag

SEQ ID NO: 51244 - DNA, 358 bp, Artificial
  Mutation in BnaA.FAD2.a introduced by TALE nuclease pair BnFAD2_T07
cctctcctccctcaccctctctcctacttcgcctggccactctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctgtgtacttag

SEQ ID NO: 51245 - DNA, 359 bp, Artificial
  Mutation in BnaA.FAD2.a introduced by TALE nuclease pair BnFAD2_T07
cctctcctccctcaccctctctactacttcgcctggcctctctactgggcctgtcaaggctgcgtcctaacgggcctctgggtcatcgcccacgaatgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51246 - DNA, 363 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagtgcgggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51247 - DNA, 355 bp, Artificial; identical to SEQ ID NO: 47161
  Mutation in BnaA.FAD2.a introduced by TALE nuclease pair BnFAD2_T07

SEQ ID NO: 51248 - DNA, 365 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggtcggccaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 51249 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggctcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51250 - DNA, 351 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccgtcggccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51251 - DNA, 355 bp, Artificial
  Mutation in BnaA.FAD2.a introduced by TALE nuclease pair BnFAD2_T07
cctctcctccctcaccctctctcctacttcgcctggcctctctacttggcctgccagggctgcgtcctaaccggcgtctgggtcatagcccacgagtaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51252 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggctggacgacaccgtcggcctcatcttccactccttcctcctcgtcccttacttctcctggaagtacagtcatcgacgccacaattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51253 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcggacatcaagtggtacggcaagtacctcaacaaccctttgggacgcaccgtgatgttaacggttcagttcactctcggctggcctttgtacttag

SEQ ID NO: 51254 - DNA, 282 bp, Artificial
  Mutation in BnaA.FAD2.a introduced by TALE nuclease pair BnFAD2_T07
cctcagctccctcaccctctctcctacacgctttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51255 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctgtgtacttag

SEQ ID NO: 51256 - DNA, 349 bp, Artificial; identical to SEQ ID NO: 46483
  Mutation in BnaA.FAD2.a introduced by TALE nuclease pair BnFAD2_T07

SEQ ID NO: 51257 - DNA, 359 bp, Artificial
  Mutation in BnaA.FAD2.a introduced by TALE nuclease pair BnFAD2_T07
cctctcctccctcaccctctctcctacttcgcctggcctctctactgggcctgacaagggtgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaaggaccgcaacatcccatgaggacgcacggtgatgctaaccggccatttcacgcgcggctctccggtgtacttag

SEQ ID NO: 51258 - DNA, 282 bp, Artificial
  Mutation in BnaA.FAD2.a introduced by TALE nuclease pair BnFAD2_T07
cctctcctccctcaccctctctcctacacgctttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51259 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51260 - DNA, 358 bp, Artificial; identical to SEQ ID NO: 46206
  Mutation in BnaA.FAD2.a introduced by TALE nuclease pair BnFAD2_T07

SEQ ID NO: 51261 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51262 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagccatcgacgccaccattccaacaccggatccctcgagagggacgaagtgtttgtccccaagaagaagtcagacatcaagtggtacggcaagtacctcaacaacccttggggacgcaccgtgatgttaacggttcagttcgctctcggctggcctttgtacttag

SEQ ID NO: 51263 - DNA, 298 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51264 - DNA, 298 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcctcgtcttccactccttcctcctcgtcccttacttctcctggaagtacagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51265 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51266 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatggcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51267 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgactaccagtggttggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51268 - DNA, 358 bp, Artificial
  Mutation in BnaA.FAD2.a introduced by TALE nuclease pair BnFAD2_T07
cctctcctccctcaccctctctcctacttcgcctggcacctctactgggcctgccaaggctgcgtcctaacgggcctctgggtcatcgcccacgaatgccaccacgccttcaccgaccaccagtggctggacgacgccgtgggcctcgtcttccactccttcctcctcgtcccttacttctcctggaagtacagccatcgacgccaccattccaacactggctccctcgagagagacgaagtgtttgtacccaagaagaagtcagacatcaagtgatacggagagtaccgcaacagccatctgggacgcaccgtgaggttaacggttcagttctctctcggctggccgttgtacttag

SEQ ID NO: 51269 - DNA, 331 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51270 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatcgcccacgaatgcggccagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51271 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtaatgttaacggttcagttcactctcggctggcctttgtacttag

SEQ ID NO: 51272 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgagtgcgggccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51273 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagcccggtgggacgcaccgggaggttaacagttcagttctctttcggctggccgtggtacgtag

SEQ ID NO: 51274 - DNA, 357 bp, Artificial
  Mutation in BnaA.FAD2.a introduced by TALE nuclease pair BnFAD2_T07
cctctcctccctcaccctctcccttaccccgcctggccaccttactgggcctgccagggctgcgtcctaaccggcgtctgggtcatcgcccacgagtgaaccacgccttcagcgactaccagtggcttgacgacaccgtcgggctcatcttccactccttcctcctcgtcccttacttctccgggaagtacagtcatcgacgccaccattccaacactggctccctcgagagagacgaagtgtttgtccccaagaagaagtcagacatcaagtggtacggcaagtacctcaacaacccgttgggacgcaccgggatgttaacggttcagttcactcgcggctgcccagagtacttag

SEQ ID NO: 51275 - DNA, 358 bp, Artificial
  Mutation in BnaA.FAD2.a introduced by TALE nuclease pair BnFAD2_T07
cctctcctccctcaccctctatcctacttcgcctggcctctctactgggcctgccaagggtgcgtcctaaccggcgtctgggtcatagcccacgagtgccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcgtcgtgaggttaacggatcagttcacgctcggctggcctttttacttag

SEQ ID NO: 51276 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcgatgaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 51277 - DNA, 358 bp, Artificial
  Mutation in BnaA.FAD2.a introduced by TALE nuclease pair BnFAD2_T07
cctctcctccctcaccctctctcctacttcgcctggcctctctcccgggcctgccaagggcgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcagcaaccctttgggacgcaccgtgaggttaacggttcagttcactctcggctggcctttgtacttag

SEQ ID NO: 51278 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcccaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51279 - DNA, 386 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgatcgagatcgcccggaacagcacccaccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51280 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgctaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51281 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccacgccttcagcgaccaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51282 - DNA, 331 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 51283 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggctcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacaaccctttgggacgcaccgtgatgttaacggtccagttcacgctcggctggcctttgtacttag

SEQ ID NO: 51284 - DNA, 358 bp, Artificial
  Mutation in BnaA.FAD2.a introduced by TALE nuclease pair BnFAD2_T07
cctctcctccctcaccctctctcctacttcgcctggcccctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51285 - DNA, 362 bp, Artificial
  Mutation in BnaA.FAD2.a introduced by TALE nuclease pair BnFAD2_T07
cctctcctccctcaccctctcccttacctcgcctgccccctctactgggcctgccaaggctgcgtcctcacgggcctctgggtcatcgcccacgaatgcgggccaccacaccttccgcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccatttgggacgcaccgtgatgtttacggttcagttcactctcggctggcctttgtacttag

SEQ ID NO: 51286 - DNA, 342 bp, Artificial
  Mutation in BnaA.FAD2.a introduced by TALE nuclease pair BnFAD2_T07
cctctcctccctcaccctctctcctacttcgcctggcctctctattgggcctgccagggctgcgtcctaaccggcgtcctaaccaccacgccttcagcgactaccagtggctggacgacaccgtcggcctcatcttccactacttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51287 - DNA, 359 bp, Artificial
  Mutation in BnaA.FAD2.a introduced by TALE nuclease pair BnFAD2_T07
cctctcctccctcaccctctcccttacctcgcctggcccctctactgggcctgtcaaggctgcgtcctaacgggcctctgggtcatagcccacgagtggccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51288 - DNA, 358 bp, Artificial; identical to SEQ ID NO: 47723
  Mutation in BnaA.FAD2.a introduced by TALE nuclease pair BnFAD2_T07

SEQ ID NO: 51289 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51290 - DNA, 357 bp, Artificial
  Mutation in BnaA.FAD2.a introduced by TALE nuclease pair BnFAD2_T07
cctctcctccctcaccctctcccttacctcgcctggactctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcaggtcactcgcggctggccttggtacttag

SEQ ID NO: 51291 - DNA, 358 bp, Artificial
  Mutation in BnaA.FAD2.a introduced by TALE nuclease pair BnFAD2_T07
cctctcctccctcaccctctcccttacctcgcctgtcccctctactggtcctgccccgactgcgtcctaacgggcctctgggtcctcgcccacgcatgccaccccgccttcagcgaccaccagtggctggacgacgccgtgggcctcgtcttccactcctgcctcctcgtcccttacttctcctggaagtacagtcatcgacgccaccagtccaacactggctccctcgagagagacgaagtgtttgtccccaagaagaagtcagacagcaagtggtacggcaagtacctcaacaaccctttgggacgcaccgtgaggttaacggttcagttcactctcggagggcctttgtacttag

SEQ ID NO: 51292 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 51293 - DNA, 354 bp, Artificial
  Mutation in BnaA.FAD2.a introduced by TALE nuclease pair BnFAD2_T07
cctctcctccctcaccctctcacttacctcgcctggcccatctaatgggcctgccaaggctgcgtcctaacgggcctctgggtcatcgcccacgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactcgcggctggcctttgtacttag

SEQ ID NO: 51294 - DNA, 358 bp, Artificial; identical to SEQ ID NO: 48085
  Mutation in BnaA.FAD2.a introduced by TALE nuclease pair BnFAD2_T07

SEQ ID NO: 51295 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgttatgttaacggttcagttcactctcggccggcctttgtacttag

SEQ ID NO: 51296 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51297 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcttctgggtcatagcccacgagtgcgactaccagtggttggacgacaccttcggcctcatcttccactccttcctcctcgtcccttacttctcctggaagtacagtcatcgacgccaccatttcaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51298 - DNA, 360 bp, Artificial
  Mutation in BnaA.FAD2.a introduced by TALE nuclease pair BnFAD2_T07
cctctcctccctcaccctctatcctacttcgcctggcctctctactgggcctgccagggctgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51299 - DNA, 357 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtgtaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51300 - DNA, 342 bp, Artificial
  Mutation in BnaA.FAD2.a introduced by TALE nuclease pair BnFAD2_T07
cctctcctccctcaccctctctcctacttcgcctggcctctctattgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccaggtcacgctcggctggcctttgtacttag

SEQ ID NO: 51301 - DNA, 357 bp, Artificial
  Mutation in BnaA.FAD2.a introduced by TALE nuclease pair BnFAD2_T07
cctctcctccctcaccctctgtcctacttcgcctggcatctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 51302 - DNA, 349 bp, Artificial
  Mutation in BnaA.FAD2.a introduced by TALE nuclease pair BnFAD2_T07
cctctcctccctcaccctctcccctacttcgcctggcccctctactgggcctgccagggctgcgtcctaaccggcctctgggtcatagcccaccactccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51303 - DNA, 258 bp, Artificial
  Mutation in BnaA.FAD2.a introduced by TALE nuclease pair BnFAD2_T07
cctctcctccctcaccctctatcctacttcgcctggcctctctactgggcctgccaaggctgcgtcctaacgggcctctgggtaatcgcccacgaatgcggcaccaccattccaacaccggatccctcgagagggatgaagtgttcgtccccaagaagaagtcagacatcaagtggtacgacaagtacctcaacaaccctttgggacgcaccgtgatgttaacggttcagttcactctcggctggcctttgtacttag

SEQ ID NO: 51304 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51305 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggctggacgacaccgtcggcctcatcttccactccttcctcctcgtcccttacttctcctggaattacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51306 - DNA, 356 bp, Artificial
  Mutation in BnaA.FAD2.a introduced by TALE nuclease pair BnFAD2_T07
cctctcctcctcaccctctctcctacttcgcctggcccctctactgggcctgccaaggctgcgtcctaaccggcgtctgggtaatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 51307 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccggccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51308 - DNA, 462 bp, Artificial
  Mutation in BnaA.FAD2.a introduced by TALE nuclease pair BnFAD2_T07
cctctcctccctcaccctctcccttacctcgcctggcccctctcctgggcctgccaaggctgcgtcctaacgggcctctgggtcatcgcccacgaatgcgccgccatcgtggctggcgatggccaccacctgctccggggtcaagccgtgggcctggcacagcaccggcaacagccgctggaccgtctccagcgcctgcttgccaccacgccttcagcgaccaccagtggctggacgacgccgtgggcctcgtcttccactccttcctccgcgtcccttacttctcctggaagtacaggcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctgtgtacttag

SEQ ID NO: 51309 - DNA, 342 bp, Artificial
  Mutation in BnaA.FAD2.a introduced by TALE nuclease pair BnFAD2_T07
cctctcctccctcaccctctctcctacttcgcctggcctctctattgggcctgccagggctgcgtcctaaccggcgtcctaaccaccacgccttcagcgactaccagtggcttgacgacaccgtcggtctcatcttccactccttcctcctcgtcccttacttctcatggaagtacagtcatcgacgccaccattccaacactggctccctcgagagagacgaagtgtttgtccccaagaagaagtcagacatcaagtggtacggcaagtaccgcaacaaccctttgggacgcaccgttatgttaacggttcagttcactctcgtctgtcctttgtacttag

SEQ ID NO: 51310 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgactaccagtggctggacgacgccgtgggcctcgtcttccactccttcctcctcgtcccttacttctcctggaagtacagtcatcgacgccaccattcaaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51311 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgaatgcgcaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51312 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 51313 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtgttacggccagtacctcaacaaccctttgggacgaaccgtgatgttatcggttcagttcactctcggctggcctttgtacttag

SEQ ID NO: 51314 - DNA, 359 bp, Artificial
  Mutation in BnaA.FAD2.a introduced by TALE nuclease pair BnFAD2_T07
cctctcctccctcaccctctctcctacttcgcctggcatctttcctgggcctgccagggctgcgtcctaacaggcgtctgggtcatagcccacgagtgcccaccacgccttcagcgactaccagtggctggacgacaccgtcggcctcatcttccactccttcctcctcctcccttacttctcctggaactacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcgtgcgccatgtgtacttag

SEQ ID NO: 51315 - DNA, 355 bp, Artificial
  Mutation in BnaA.FAD2.a introduced by TALE nuclease pair BnFAD2_T07
cctctcctccctcaccctctctcctacttcgcctggcctctctaccgagcctgccagggctgcgtcctaaccgacgtctgggtcacagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcagcaaccctttgggacgcaccgtgaggttaacggtacaggtgactctcggctggcctttgtgcttag

SEQ ID NO: 51316 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51317 - DNA, 358 bp, Artificial
  Mutation in BnaA.FAD2.a introduced by TALE nuclease pair BnFAD2_T07
cctctcctccctcaccctctcccttacctcgcctggctcctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagccatcaagtggtacggcaagtacctcaccaaccctttgggacgcaccgtgatgataacggttcaattcactcccggctggcctttgtacttag

SEQ ID NO: 51318 - DNA, 352 bp, Artificial
  Mutation in BnaA.FAD2.a introduced by TALE nuclease pair BnFAD2_T07
cctctcctccctcaccctctatcctacttcgcctggcctctctactgggcctgccagggctgcgtcctaaccggcgtctgggtcatcgcccacgagcacgccttcagcgactaccagtggctggacgccaccgtcggcctcatcttccactccttcctcctcgtcccttacttctcctggaagtacagtcatcgacgccaccattccaacacttgctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51319 - DNA, 357 bp, Artificial
  Mutation in BnaA.FAD2.a introduced by TALE nuclease pair BnFAD2_T07
cctctcctccctcaccctctctcctacttcgcctggcatatctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51320 - DNA, 299 bp, Artificial
  Mutation in BnaA.FAD2.a introduced by TALE nuclease pair BnFAD2_T07
cctctcctcccccaccctctcccctactacgcctggcctcccccacgccttcagcgactaccagtggcatgacgacaccgtcggcctcatcttccactccttcctcctcgtcccttacgtctcctggcagtacagccatcgacgccaccattccaacaccggatccctcgagagggatgaagtgttcgcccccaagaagaagtcaaacatcgagtggtacggcaaggacctcaacaaccctttgggtcgcaccgtgatgttaacgtttcatgtgactctcgcgtggcctttgtacttag

SEQ ID NO: 51321 - DNA, 345 bp, Artificial
  Mutation in BnaA.FAD2.a introduced by TALE nuclease pair BnFAD2_T07
cctctcctccctcaccctctctcctacttcgcctggcctctctactgggcctgccagggctgcgccctaaccggcgtctgggtcatagcccacgattcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtccgacatcaagtggtctggcaagtcccccaccaccccggtaggacgcaaggtgctgcctaccctccagttcccgctcggctggcctttgtacttag

SEQ ID NO: 51322 - DNA, 350 bp, Artificial
  Mutation in BnaA.FAD2.a introduced by TALE nuclease pair BnFAD2_T07
cctctcctccctcaccctctcccttacctcgcctggcccctctactgggcctgccaagggtgcgtcctaaccggcgtctgggtcatagcccaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctctgggacgcaccgtgatgttaacggttcagttcactctcggctggcctttgtacttag

SEQ ID NO: 51323 - DNA, 417 bp, Artificial
  Mutation in BnaA.FAD2.a introduced by TALE nuclease pair BnFAD2_T07
cctctcctccctcaccctctcccttacctcgcctggcacctctactgggcctgccaaggctgcgtcctaacgggcctctgggtcatagcccacgagtgcggtggtggcactgacgggtgccccgctcaacttgaccccccagcaggtggtggccatcgtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51324 - DNA, 347 bp, Artificial
  Mutation in BnaA.FAD2.a introduced by TALE nuclease pair BnFAD2_T07
cctctcctccctcaccctctaccttacctcgcctggcccctctactgggcctgccaaggctgcgtcctaacgggcctctgggtcatcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51325 - DNA, 346 bp, Artificial
  Mutation in BnaA.FAD2.a introduced by TALE nuclease pair BnFAD2_T07
cctctcctccctcaccctctgccttacctcgcctggcccctctactgggcctgccaaggctgcgtcctaacgggcctctgggtcatccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtctgtccccaagaagaagtcagacatcaagtggtacggcaagtacctcaacaaccctttgggacgcaccgtgatgttaacggttcagttcactcgcggctggcctttgtacttag

SEQ ID NO: 51326 - DNA, 378 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaggagtagggaactgccagccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51327 - DNA, 358 bp, Artificial
  Mutation in BnaA.FAD2.a introduced by TALE nuclease pair BnFAD2_T07
cctctcctccctcaccctctctcctacttcgcctggcatatctaatgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 51328 - DNA, 359 bp, Artificial
  Mutation in BnaA.FAD2.a introduced by TALE nuclease pair BnFAD2_T07
cctctcctccctcaccctctcccttacctcgcctggcccctctcctgagcctgccaaggatgcgtcctaacgggcctctgggtcatcgcccacgaatgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgccccgtgatgttaacggttcaggtcactctcggctggccttagtacttag

SEQ ID NO: 51329 - DNA, 352 bp, Artificial
  Mutation in BnaA.FAD2.a introduced by TALE nuclease pair BnFAD2_T07
cctctcctccctcaccctctctcctacttcgcctggcctctctcccgggcctgccagggccgcgtcctaaccggcgtctgggtcatagcccacgagcacgccttcagcgactaccagtggctggacgacaccgtcggtctcatcttccactccttcctcctcgtcccttacttctcctggaagtacagtcatcgacgccaccattccatcactcgctccctcgagagagacgaagtgtttgtccccaagaagaagtcagacatcaagtggtgcggcaagtacctcaacagccctttgggacgcaccgtgagtttaacggctcggttcactcccggctggcctttgtgcttag

SEQ ID NO: 51330 - DNA, 331 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaaccctttggggcgcaccgtgatgttatcggttcatgtcactctcggctggcctttgtacttag

SEQ ID NO: 51331 - DNA, 358 bp, Artificial
  Mutation in BnaA.FAD2.a introduced by TALE nuclease pair BnFAD2_T07
cctctcctccctcaccctctcccttacctcgcctggcccatataatgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcacacatcaagtggtacggcaagtacctcaacaacccttttggacgcaccgtgatgttaacggttcagttcactctcggctggcctttgtacttag

SEQ ID NO: 51332 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggatgcgtcctaacgggcctctgggtcatcgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcgagtacctcaacaaccctttgggacgcaccgtgatgttaacggttcagttcactctcggctggcctttgtacttag

SEQ ID NO: 51333 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgcggcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51334 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccatgagtgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51335 - DNA, 362 bp, Artificial
  Mutation in BnaA.FAD2.a introduced by TALE nuclease pair BnFAD2_T07
cctctcctccctcaccctctctcctacttcgcctggcctatctcctgggcctgccaagggtgcgtcctaaccggcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactcgcggctggcctgtgtacttag

SEQ ID NO: 51336 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagaaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51337 - DNA, 364 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtatgggtcatagcccacgagtgcgtgcctaaccacgccttcagcgactaccagtggcttgacgacaccgtcggtctcatcttccactccttcctcctcgtcacttacttctcctggaagtacagtcatcgacgccaccattccaacactggctccctcgagagggatgaagtgttcgtccccaagaagaaatccgacatcaagtggtacggaaattacctcaacaacccgctaggacgcacggtgatgctaaccgtccagttcacgctcggctggcctttgtacttag

SEQ ID NO: 51338 - DNA, 407 bp, Artificial
  Mutation in BnaA.FAD2.a introduced by TALE nuclease pair BnFAD2_T07
cctctcctccctcaccctctctcctacttcgcctggcatatctactgggcctgccaagggtgcgtcctaaccggcgtctgggtcatagcccacgagtgcggcgcctgcttgccgccatcgtggctggcgatggccaccacctgctccccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggcgggcctttgtacttag

SEQ ID NO: 51339 - DNA, 353 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtaagacatcaagtggtacggcaagtacctcaacaaccctttgggacgcaccgtgatgttaacggttcagttcactctcggctggcctttgtacttag

SEQ ID NO: 51340 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51341 - DNA, 364 bp, Artificial
  Mutation in BnaA.FAD2.a introduced by TALE nuclease pair BnFAD2_T07
cctctcctccctcaccctctctcctacttcgcctgtcctctctactgggcctgccagggctgcgtcctaaccggcgtctgggtcatagcccacgagtgcgtgcctaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51342 - DNA, 364 bp, Artificial
  Mutation in BnaA.FAD2.a introduced by TALE nuclease pair BnFAD2_T07
cctctcctccctcaccctctctcctacttcgcctgtcctctctactgggcctgccagggctgcgtcctaaccggcgtctgggtcatagcccacgagtgcgtgcctaaccacgccttcagcgactaccagtggcttgacgacaccgtcggtctcatcttccactccttcctcctcttcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51343 - DNA, 282 bp, Artificial
  Mutation in BnaA.FAD2.a introduced by TALE nuclease pair BnFAD2_T07
cctctcctccctcaccctctctcctacacgctttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51344 - DNA, 365 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagtgcggtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51345 - DNA, 359 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51346 - DNA, 327 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51347 - DNA, 358 bp, Artificial; identical to SEQ ID NO: 46664
  Mutation in BnaA.FAD2.a introduced by TALE nuclease pair BnFAD2_T07

SEQ ID NO: 51348 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatagcccacacacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51349 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51350 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacagcaagtggtacggcaagtacctcaacaacccttggggacgcaccgtgatggtaacggttcagttcactctcggctggcctttgtacttag

SEQ ID NO: 51351 - DNA, 358 bp, Artificial
  Mutation in BnaA.FAD2.a introduced by TALE nuclease pair BnFAD2_T07
cctctcctccctcaccctctctcctacttcgcctggcctctctactgggcctgtcaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51352 - DNA, 433 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgggggagaggcggttttcgtattgggggctctttcccttcctcgcccccttgatccctgcgctcggtcgttccgccaccaccccttcagcgactaccaatggctggacgacaccgccggcttcatcttccactccttcctcctcctcccttacttcgcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51353 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaaccacgccttcagcgactaccagtggctggacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51354 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacaagtgcggaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaagggttcagttcactctcggctggcctttgacttag

SEQ ID NO: 51355 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggaccacgccttcagcgaccaccagtggctggacgacgccgtgggcctcgtcttccactccttcctcctcgtcccttacttctcctggaagtacagtcatcgacaccaccattccaacactggctccctcgagagagacgaagtgtttgtccccaagaagaagtcagacatcaagtggtacggaaagtacctcaacaacccgctaggacgcacggtgatgctaaccgtccagttcacgcgcggctggcctttgtacttag

SEQ ID NO: 51356 - DNA, 359 bp, Artificial
  Mutation in BnaA.FAD2.a introduced by TALE nuclease pair BnFAD2_T07
cctctcctccctcaccctctctcctacttcgcctggcctctctgctgggcctgccagggctgcgtcctaaccggcgtctgggtcatagcccacgagtgcgcaccacgccttcagcgactaccagtggctgggcgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51357 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgggccaccacgccttcagcgactaccagtggctggacgacaccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51358 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaaccggcgtctgggtcatagcccacgagtgcgactaccagtggttggacgacaccttcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51359 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcggctgggtcatagcccacgagtgcgactaccagtggttggacgacaccttcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacagccctttggtacgcaccgtgatgttaacggttcagttcactctcggctggcctttgtacttag

SEQ ID NO: 51360 - DNA, 359 bp, Artificial; identical to SEQ ID NO: 46363
  Mutation in BnaA.FAD2.a introduced by TALE nuclease pair BnFAD2_T07

SEQ ID NO: 51361 - DNA, 359 bp, Artificial; identical to SEQ ID NO: 47424
  Mutation in BnaA.FAD2.a introduced by TALE nuclease pair BnFAD2_T07

SEQ ID NO: 51362 - DNA, 358 bp, Artificial; identical to SEQ ID NO: 47405
  Mutation in BnaA.FAD2.a introduced by TALE nuclease pair BnFAD2_T07

SEQ ID NO: 51363 - DNA, 346 bp, Artificial; identical to SEQ ID NO: 47695
  Mutation in BnaA.FAD2.a introduced by TALE nuclease pair BnFAD2_T07

SEQ ID NO: 51364 - DNA, 358 bp, Artificial
  Mutation in BnaA.FAD2.a introduced by TALE nuclease pair BnFAD2_T07
cctctcctccctcaccctctctcctacttcgcctgtcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51365 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51366 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51367 - DNA, 364 bp, Artificial; identical to SEQ ID NO: 47392
  Mutation in BnaA.FAD2.a introduced by TALE nuclease pair BnFAD2_T07

SEQ ID NO: 51368 - DNA, 423 bp, Artificial
  Mutation in BnaA.FAD2.a introduced by TALE nuclease pair BnFAD2_T07
cctctcctccctcaccctctcccttacctcgcctggcccctctactgggcctgccaagggcgcgtcctaaccggcgtctgggtcatagcccacgagtgcgggtcaggtggtggccatcgccagcaatggcggtggcaagcaggcgctggcgccggtcccgcggccaccccgccctccgcgactaccagtggctgaacgacaccctcgcccgcatcttccactccttcctcctcgtcccttacttctccttgaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51369 - DNA, 358 bp, Artificial; identical to SEQ ID NO: 46725
  Mutation in BnaA.FAD2.a introduced by TALE nuclease pair BnFAD2_T07

SEQ ID NO: 51370 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgccaccacgccttcagcgaccaccagtggctggacgacgccgtgggcctcgtcttccactccttcctcctcgtcccttacttctcctggaagcacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51371 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgaatgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51372 - DNA, 347 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgcgtcctaacaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51373 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgcaccacgccttcagtgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51374 - DNA, 331 bp, Artificial
  Mutation in BnaA.FAD2.a introduced by TALE nuclease pair BnFAD2_T07
cctctcctccctcaccctctcccttacctcgcctggcctctctactgggcctgccaagggtgcgtcctaaccggcgtctgggtcatagcccacgaatggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttac

SEQ ID NO: 51375 - DNA, 331 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaatggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51376 - DNA, 349 bp, Artificial
  Mutation in BnaA.FAD2.a introduced by TALE nuclease pair BnFAD2_T07
cctctcctccctcaccctctcggctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacacgggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51377 - DNA, 358 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttgg

SEQ ID NO: 51378 - DNA, 358 bp, Artificial
  Mutation in BnaA.FAD2.a introduced by TALE nuclease pair BnFAD2_T07
cctctcctccctcaccctctctcctacttcgcctggactctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtccgacaagtacctcaacaaccccgtgggccgcgccgtgttgttaacagttcagttcactctcggctggcctttgtacttag

SEQ ID NO: 51379 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51380 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgaatgcaccacgccttcagcgaccaccagcggctggacgacggcgtaggcctcgtcttccactccttcctcctcgtcccttacttctcctggaagtacagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51381 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 51382 - DNA, 343 bp, Artificial
  Mutation in BnaA.FAD2.a introduced by TALE nuclease pair BnFAD2_T07
cctctcctccctcaccctctctcctacttcgcccggcctctctactgggcctgccagggctgcgtcctaaccggcttctgggtcatagcccacgagtgcgactaccagtggcttgactacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaaggtccgcaacaaccctttgggacgcaccgtgatgttaacgggtcaggtcactctcgtctgtcctttgtgcttag

SEQ ID NO: 51383 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccatggctgcgtcctaaccggcgtctgggtcatagcccacgagtgcggcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51384 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 51385 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcaaacatcaagtggtacggcaagtgcctcaacaaccatgtgggacgcaccgtgatgttaacggctcagttcactctcggctggcctttgtacttag

SEQ ID NO: 51386 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggaggcaccgtgatgttaacggttcagttcactctcggctggcctttgtacttag

SEQ ID NO: 51387 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtgggcctcgtcttccactccttcctcctcgtcccttacttctcctggaagtacagccatcgacgccaccattccaacacctgatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51388 - DNA, 282 bp, Artificial
  Mutation in BnaA.FAD2.a introduced by TALE nuclease pair BnFAD2_T07
cctctcctccctcaccctctctccaccacgccttcagcgactatcagtggctggacgacaccgtcggccgcatcttccactccttcctcctcgtcccttacttctcctggaagtacagtcatcgacgccaccattccaacactggctccctcgagagagacgaagggtttgtccccaagaagaagtcagacatcaagtggtacggaaagtacctcaacaacccgctaggacgcacggggatgctaaccgtccagttcacgctcgggtgccctttgtacttag

SEQ ID NO: 51389 - DNA, 282 bp, Artificial
  Mutation in BnaA.FAD2.a introduced by TALE nuclease pair BnFAD2_T07
cctctcctccctcaccctctctccaccacgccttcagcgactatcagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51390 - DNA, 359 bp, Artificial; identical to SEQ ID NO: 46252
  Mutation in BnaA.FAD2.a introduced by TALE nuclease pair BnFAD2_T07

SEQ ID NO: 51391 - DNA, 258 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcccaacgggcctctgggtcatcgcccacgaatgcggcaccaccattccaacactggctccctcgagagagacgaagtgtttgtccccaagaagaagtcagacatcaagtggtacggcaagttcctcaacaaccctttgggacgcaccgtgatgtttacggttcagttcactctcggctggccttagtacttag

SEQ ID NO: 51392 - DNA, 363 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactcgcggctggcctgtgtacttag

SEQ ID NO: 51393 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaaatgccaccacgccttcagcgaccaccagtggctggacgacgccgtgggcctcgtcttccactccttcctcctcgtcccttacttctcctggaagtacagtcatcgacgccaccattccaacactggctcccccgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51394 - DNA, 363 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttgactctcggctggcctttgtacttag

SEQ ID NO: 51395 - DNA, 282 bp, Artificial
  Mutation in BnaA.FAD2.a introduced by TALE nuclease pair BnFAD2_T07
cctctcctccctcaccctctctcctacaccctttcacccactaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggaaagtacctcaacaaccctttgggacgcaccgtgatgttaacggttcaggtcactctcggctggcctttgtacttag

SEQ ID NO: 51396 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagatgaagtcagacatcaagtggtacggcaagtacctcaacaaccctttgggacgcaccgtgatgttaacggttcagttcactctcggctggcctttgtacttag

SEQ ID NO: 51397 - DNA, 356 bp, Artificial; identical to SEQ ID NO: 46604
  Mutation in BnaA.FAD2.a introduced by TALE nuclease pair BnFAD2_T07

SEQ ID NO: 51398 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgggtcaggtcactctcgtctggcctttgtacttag

SEQ ID NO: 51399 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggccaaccacgccttcagcgactaccagtggctggacgacaccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatggtaacggttcagttcactctcgcctggcctttgtacttag

SEQ ID NO: 51400 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgcgcggctggcctttgtacttag

SEQ ID NO: 51401 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggctcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51402 - DNA, 349 bp, Artificial
  Mutation in BnaA.FAD2.a introduced by TALE nuclease pair BnFAD2_T07
cctctcctccctcaccctctcacttacctcgcctggcccctctactgagcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcagcatccgttttggacgcaccgtgatgttaacggttcagttccctcgcgcctgcccttagtacttag

SEQ ID NO: 51403 - DNA, 342 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacgtttcagttcactctcggctggcctttgtacttag

SEQ ID NO: 51404 - DNA, 342 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 51405 - DNA, 358 bp, Artificial
  Mutation in BnaA.FAD2.a introduced by TALE nuclease pair BnFAD2_T07
cctctcctccctcaccctctctcctacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctagagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51406 - DNA, 358 bp, Artificial; identical to SEQ ID NO: 47103
  Mutation in BnaA.FAD2.a introduced by TALE nuclease pair BnFAD2_T07

SEQ ID NO: 51407 - DNA, 357 bp, Artificial
  Mutation in BnaA.FAD2.a introduced by TALE nuclease pair BnFAD2_T07
ccactcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51408 - DNA, 356 bp, Artificial
  Mutation in BnaA.FAD2.a introduced by TALE nuclease pair BnFAD2_T07
cctctcctccctcaccctctctcctacttcgcctggcctctctactgggcctgccagggctgcgccctaaccggcgtctgggtcatagcccaccagccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacggttccgttcactctcggctggcctttgtacttag

SEQ ID NO: 51409 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51410 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatcgcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51411 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcacacgagtgcgactaccagtggttggacgacaccttcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51412 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgtgtcctaacgggcctctgggtcatcgcccacgaataccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51413 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcttctgggtcatagcccacgagtgcgactaccagtggttggacgacaccttcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccatttcacgctcggctggcctttgtacttag

SEQ ID NO: 51414 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcccggctggcctgtgtacttag

SEQ ID NO: 51415 - DNA, 360 bp, Artificial
  Mutation in BnaA.FAD2.a introduced by TALE nuclease pair BnFAD2_T07
cctctcctccctcaccctctctcctacttcacctggcctctctactgggcctgccagggctgcgtcctaaccggcgtctgggtcatagcccacgagtgcggccacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51416 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 51417 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51418 - DNA, 357 bp, Artificial; identical to SEQ ID NO: 46670
  Mutation in BnaA.FAD2.a introduced by TALE nuclease pair BnFAD2_T07

SEQ ID NO: 51419 - DNA, 353 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51420 - DNA, 423 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggtcaggtggtggccatcgccagcaatggcggtggcaagcaggcgctggagacggtccagcggccaccacgccttcagcgactaccagtggcttgacgacaccgtcggtctcatcttccactccttcctcctcgtcccttacttctcctggaagtacagtcatcgacgccaccattccagcactggctccctcgagagagacgaagtgtttgtccccaagaagaagtcagacatcaagtggtacggcaaggacctcaacaaccctgtgggacgcaccgtgatgttaacggttcagttcactcgcggctggccttagtacttag

SEQ ID NO: 51421 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtgcttag

SEQ ID NO: 51422 - DNA, 358 bp, Artificial; identical to SEQ ID NO: 47578
  Mutation in BnaA.FAD2.a introduced by TALE nuclease pair BnFAD2_T07

SEQ ID NO: 51423 - DNA, 357 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 51424 - DNA, 360 bp, Artificial
  Mutation in BnaA.FAD2.a introduced by TALE nuclease pair BnFAD2_T07
cctctcctccctcaccctctctcctacttcgcctggcctctctaatgggcctgccagggctgcgtcctaaccggcgactgggtcatagcccacgagtgcgccaccacgcattcagcgactaccagtggctggacgacaccgtcggcctcatcttccactccttcctcctcgtcccttacttctcctggaagtacagtcatcgacgccaccattccaacactggctcccgcgagagagacgaagtgtttgtccccaagaagaaggcagacatcaagtggtacggcaagtacctcaacaaccctgtgggacgcagcgggaggttatgggggcagttcggtcgcggggggcctgtgtacttag

SEQ ID NO: 51425 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggctggacgacaccgtcggcctcatcttccactccttcctcctcgtcccttacttctcctggaagtacagtcatctacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51426 - DNA, 359 bp, Artificial
  Mutation in BnaA.FAD2.a introduced by TALE nuclease pair BnFAD2_T07
ccttctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51427 - DNA, 282 bp, Artificial
  Mutation in BnaA.FAD2.a introduced by TALE nuclease pair BnFAD2_T07
cctctcctccctcaccctctctcctacacgctttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51428 - DNA, 364 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51429 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggctggaccacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactcgcggctgcccttagtacttag

SEQ ID NO: 51430 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcgggtggcctttgtacttag

SEQ ID NO: 51431 - DNA, 362 bp, Artificial
  Mutation in BnaA.FAD2.a introduced by TALE nuclease pair BnFAD2_T07
cctctcctccctcaccctctctcctacttcgcctggcctccctcctgggcctgacagggctgcgtcctcaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacacgggctccctcgagagagacgaagtgtttgtccccaagaagaagtcagacatcaagtggtacggcaagtaccccaacaaccctgtgggacgcaccgggatggtaacgttgcaggtctctcgtgtgtggcatgagtacttag

SEQ ID NO: 51432 - DNA, 298 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactcgcggctggcctgggtacttag

SEQ ID NO: 51433 - DNA, 309 bp, Artificial
  Mutation in BnaA.FAD2.a introduced by TALE nuclease pair BnFAD2_T07
cctctcctccctcaccctctctcctacttcgcctggcctctctactgggccaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51434 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgtaccacgccttcagcgactaccagtggctggacgacaccgtcggcctcatcttccactccttcctcctcgtcccttacttctcctggaagtaaagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 51435 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51436 - DNA, 282 bp, Artificial
  Mutation in BnaA.FAD2.a introduced by TALE nuclease pair BnFAD2_T07
cctctcctccctcaccctctctcctacacgctttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 51437 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggttcggcaagtacctcaacagccctgtgggacgcaccgtgatgttaacggttcagttcactctcggctggcctttgtacttag

SEQ ID NO: 51438 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcccaccacgccttcagtgaccaccagtggctggacgacgccgtgggcctcgtcttccactccttcctcctcgtccattacttctcctggaagtacagtcatcgacgccaccattccaacactggctccctcgagagagacgaagtgtttgtccccaagaagaagtcagacatcaagtggtacggcaagtacctcaacaaccctttgggacgcaccgagatggtgacggttcagttcactctcggctgcccttggtacttag

SEQ ID NO: 51439 - DNA, 358 bp, Artificial
  Mutation in BnaA.FAD2.a introduced by TALE nuclease pair BnFAD2_T07
cctctcctccctcaccctctcccttacctcgcctggcccccctactgggcctgccaaggctgcgtcctaccgggcctctgggtcatcgcccacgaatgcgaccacgccttcagcgaccaccagtggctggacgacgccgtgggcctcgtcttccactccttcctcctcgtcccttacttctcctagaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcgggttccctttgtacttag

SEQ ID NO: 51440 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgccaccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51441 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51442 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccgttgtacttag

SEQ ID NO: 51443 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcgccaccacgccttcagcgaccaccagtggctggacgacgccgtgggcctcgtcttccactccttccacctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacgggtcagttctctctcggctggcctttgtacttag

SEQ ID NO: 51444 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccgtttgggacgcaccgtgatgttaacggttcagttcactctcggctggccttagtacttag

SEQ ID NO: 51445 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggccaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51446 - DNA, 356 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagccaccacgccttcagcgactaccagtggctggacgacaccgtcggcctcatcttccactccttcttcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51447 - DNA, 352 bp, Artificial
  Mutation in BnaA.FAD2.a introduced by TALE nuclease pair BnFAD2_T07
cctctcctccctcaccctctctactacttcgcctggcctctctactgggcctgccagggctgcgtcctaaccggcgtctgggtcatcgcccacgagtgcgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 51448 - DNA, 352 bp, Artificial
  Mutation in BnaA.FAD2.a introduced by TALE nuclease pair BnFAD2_T07
cctctcctccctcaccctctctcctacttcgcctggtctctctactgggcctgccagggctgcgtcctaaccggcgtctgggtcatagcccacgagcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcgactacctcaacaaccctgtgggacgcaccgtgatgttaacggtgcagttcactctcggctggcctttgtacttag

SEQ ID NO: 51449 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgtagtgtttgtccccaagaagaagtcagacatcaagtggtacggcaagtacctcaacagccctttgggacgcaccgtgatgttaacggttcagttcactctcggctggccttttacttag

SEQ ID NO: 51450 - DNA, 406 bp, Artificial
  Mutation in BnaA.FAD2.a introduced by TALE nuclease pair BnFAD2_T07
cctctcctccctcaccctttatcctacttctcctggcctctctactgcgcctgccagggctgcgtcctaacccgcgtctgggtcatagcccacgagtgcggagcggatttgaacgttgtgaagcaacggcccggagggtggcgggcgtaccacgccttcaaccactaccagttgctggacgacaccgtcggcctcaacttccactccttcctcctcgtcccttacttctccgggcagtacagtcatcgacgccaccattccaacactggctccctcgagagagacgaagtgtttgtccccaagaagaagtcagccatcaagtggtacggcaagtacctcaacacccctttggggcgcaccgttatgttaacggtgcatgtctctctcggctggcagttatacttag

SEQ ID NO: 51451 - DNA, 342 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtcctagccaccacgccttcagcgactaccagtggctggacgacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51452 - DNA, 258 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcctctgggtcatcgcccacgaatgcggcaccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51453 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatcgcccacgaatgcggaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51454 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51455 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51456 - DNA, 355 bp, Artificial
  Mutation in BnaA.FAD2.a introduced by TALE nuclease pair BnFAD2_T07
cctctcctccctcaccctctcccttggctcttgtggcctctcgactggtcctgacatggctgcgtcctaaccggcgtctggaacatagcccgcgggttccaggccttcagcgactaccagtggctggacgacaccgtcggcctcatcttccactccttcctcctcgtcccttacttctcctggaagtacagtcatcgacgccaccattccaacaccggctccctcgagagagacgaagtgtttgtccccaagaagcagtcagacatcaagtggtccggcaagtactccaacacgcctgataggtgcaccgtgctgttaacggttcatttcactctcggctggcctttgtacttag

SEQ ID NO: 51457 - DNA, 403 bp, Artificial
  Mutation in BnaA.FAD2.a introduced by TALE nuclease pair BnFAD2_T07
cctctcctccctcaccctctcccttacctcgcctggcacctctactgggcctgccaaggctgcgtcctaacgggcctctgggtcatagcccaccagcaatattggtggcaagcaggcgctggagacggtgcaggcgctgttgcccaccccgccttcagcggctaccagtggccggacgacaccgtcggcctcatcttccactccttcctcctcgtcccttacttctcctggaagtacagtcatcgacgccaccattccaacactggctccctcgagagagacgaagtgttggtccccaagaagaagtcagacatcaagtggtacggcaagttcctcaacaaccctgtggaacgcaccgtgaggttaacggttcagttcactcgcgcctggccttagtacctag

SEQ ID NO: 51458 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccccgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51459 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51460 - DNA, 365 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcggccggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcgagtggtacggcaagtacctcaacaacccgctaggacgcacggtgatgctaaccgtccagttcacgctcggctggcctttgtacttag

SEQ ID NO: 51461 - DNA, 382 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcggtggcaagcaggcgctggaccaccacgccttcagcgactaccagtggcttgacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51462 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacctgcgtctgggtcatagcccacgagtgcgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51463 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcggccagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51464 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgatcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51465 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgtaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51466 - DNA, 355 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtgcgacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 51467 - DNA, 453 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgcaaggttctggaccagttgcgtgagcgcatacgctacttgcattacagcttacgaaccgaacaggcttatgtccactgggttcgtgccttcatccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51468 - DNA, 357 bp, Artificial
  Mutation in BnaA.FAD2.a introduced by TALE nuclease pair BnFAD2_T07
cctctcctccctcaccctctctactacttcgcctggcctctctactgagcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51469 - DNA, 358 bp, Artificial
  Mutation in BnaA.FAD2.a introduced by TALE nuclease pair BnFAD2_T07
cctctcctccctcaccctctctcctacttcgcctggactctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 51470 - DNA, 362 bp, Artificial
  Mutation in BnaA.FAD2.a introduced by TALE nuclease pair BnFAD2_T07
cctctcctccctcaccctttctcctacttcgcctggcctctctactgggcctgccagggctgcgtcctaaccggcgtctgggtcatagcccacgagtgcggccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagtgcacgctcggctggcctttgtacttag

SEQ ID NO: 51471 - DNA, 351 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcgtctgggtcatagcccaccgtcggccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacagccctttgtgacgcaccgtgatggtaacggttcagttcactctcggctggcctttgtacttag

SEQ ID NO: 51472 - DNA, 359 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcccaccacgccttcatcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51473 - DNA, 355 bp, Artificial
  Mutation in BnaA.FAD2.a introduced by TALE nuclease pair BnFAD2_T07
cctctcctccctcaccctctctcctacttcgcctggcctcactactgggcctgccagggctgcgtcctaaccggcgtctgggtcatagcccacgagtaccacgccttcagcgactaccagtggcttgacgacaccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggccgttgtacttag

SEQ ID NO: 51474 - DNA, 362 bp, Artificial
  Mutation in BnaA.FAD2.a introduced by TALE nuclease pair BnFAD2_T07
cctctcctccctcaccctgtcccttacctcgcctggcccctctactgggcctgccaaggctgcgtcctaacgggcctctgggtcatcgcccacgaatgcgggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 51475 - DNA, 362 bp, Artificial
  Mutation in BnaA.FAD2.a introduced by TALE nuclease pair BnFAD2_T07
cctctcctccctcaccctctctcctacttcgcctggcctctcttctgggcctgccaagggtgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattcctacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51476 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtcggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51477 - DNA, 358 bp, Artificial
  Mutation in BnaA.FAD2.a introduced by TALE nuclease pair BnFAD2_T07
cctctcctccctcaccctctcccttacctcgtctggacactctactggtcctcccaagggtgcgtcctaaccgccgtctgggtcatagcccacgagtgccaccatgccttcagcgactaccagtggctggacgactccgtgggcctcgtcttccactccttcctcctcgtcccttacttctcctggaagtacagtcatcgacgccaccattccaacactggctccctcgagagagacgaagtgtttgtccccaagaagaagtcagacatcaagtggcacggcaattccctcaacacccctgtggggcgcaccggaatgttaccggttcagttcactctcggctggcctttgtacttag

SEQ ID NO: 51478 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51479 - DNA, 363 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggtccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51480 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgggccaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagatcactctcggctggcctttgtacttag

SEQ ID NO: 51481 - DNA, 402 bp, Artificial
  Mutation in BnaA.FAD2.a introduced by TALE nuclease pair BnFAD2_T07
cctctcctccctcaccctgtcccttacctcgcctcgcccctctactgggcctgccaaggctgcgtcctaaccggcgtctgggtcatagcccacgagtgcttcaggaaccggatcaaagagttcctccgccgctggacctaccaaggcaacgctatgtagactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtccggcaagtacctcaacagccctttgggacgcaccgtgatgttatcggttcagttctctctcggctggccgttgtacttag

SEQ ID NO: 51482 - DNA, 325 bp, Artificial
  Mutation in BnaA.FAD2.a introduced by TALE nuclease pair BnFAD2_T07
cctctcctccctcaccctctcccttacctcgcctggcccctctactgggcctgccagggctgcgtctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51483 - DNA, 344 bp, Artificial
  Mutation in BnaA.FAD2.a introduced by TALE nuclease pair BnFAD2_T07
cctctcctccctcaccctctcccttacctcgcctggcccctctactgggcctgccaagggtgcgtcctaaccggcgtctgggtcatagcccacgagtgcgggctaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatcagacatcaagtggtacggcaagtacctcaacaaccctttgggacgcaccgtgatgttaacggttcagttcactctcggctggcctttgtacttag

SEQ ID NO: 51484 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaccacgccttcagcgaccaccaggggctggacgacaccgtcggtctcatcttccactccttcctcctcgtcccttacttctcctggaagtacagtaatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 51485 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctagcctttgtacttag

SEQ ID NO: 51486 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51487 - DNA, 355 bp, Artificial
  Mutation in BnaA.FAD2.a introduced by TALE nuclease pair BnFAD2_T07
cctctcctccctcaccctctcccttacctcgcctaccccctctactgggcctgccagggctgcgtcctaaccggcgtctgggtcatagcccacgagtgccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacatccctttgggacgcgccgtgatgttaacggttcagttcgctctcggctggcctttgtacttag

SEQ ID NO: 51488 - DNA, 357 bp, Artificial
  Mutation in BnaA.FAD2.a introduced by TALE nuclease pair BnFAD2_T07
cctctcctccctcaccctctctactacttcgcctggcctctctactgggcctgccagggctgcgtcctaaccggcgactgggttttcgcccacgagtgcaccacgccttcagcgactaccagtgactggacgacaccgtcggcctcatcttccactccttcctcctcgtcccttacttctccaggaagtacagccatcgacgccaccattccaacactggctccctcgagagagacgaagtgtttgtccccaagaagaagtcagacatcaagtggtacggcatggacctcaacaaccctttgggacgcaccgtgatcttagcggtgcagtactcgcgcggctggccttggtacttag

SEQ ID NO: 51489 - DNA, 358 bp, Artificial
  Mutation in BnaA.FAD2.a introduced by TALE nuclease pair BnFAD2_T07
cctctcctccctcaccctgtcctttacctcgcctcccccctccagtcggcctgccaaggctgcgtcctcacgagcctctgggtcatagcccacgagtgccaccacgccttcagcgactaccagtggctggacgacaccgtcggcctcatcctccactccttcctcctcgtcccttacttctcctggaagtacagtcatcgacgccaccattccaacactggctccctcgagagagacgaagtgtttgtccccaagaagaagtcagacatcaagtggtacgacaagtacctcaacaacccttgtggacgcgccgtggtttcagcgggtcatttctgtctccgctggccttagcacttag

SEQ ID NO: 51490 - DNA, 363 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggggccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51491 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtaaggcaagtacctcaccaaccctttgggacgcaccgtgatgttaacggttcagttcactctcggctggcctttgtacttag

SEQ ID NO: 51492 - DNA, 347 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgcgtcctaacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 51493 - DNA, 353 bp, Artificial
  Mutation in BnaA.FAD2.a introduced by TALE nuclease pair BnFAD2_T07
cctctcctccctcaccctctctcctacttcgcctggccactctactgggcctgccagggctgcgtcctaacaggcgtctgggtcatcgcccacgaatgacgccttcagcgactccccgtggctggacgactccgtcggcctcttcttccactccttcctcctcgtcccttacttctcctggaagtacagtcatcgacgccaccattccaacaccggctccctcgagagggatgaagtgttcgtccccaagaagaaatccgacatcaagtggtacggaaagtacctcaacaaccctctaggacgcacggtgatgttaacggttcagttcactctcggctggcctttgtacttag

SEQ ID NO: 51494 - DNA, 363 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggcccaccacgccttcagcgactaccagtggttggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51495 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 51496 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51497 - DNA, 357 bp, Artificial
  Mutation in BnaA.FAD2.a introduced by TALE nuclease pair BnFAD2_T07
cctctcctccctcaccctttctcctacttcgcctggccactctcctaggcctgccagggctgcgtcctaaacggcgtctgggtcatagcccacgagtgcaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacaaccctttgggtcgcaccgtgatgttaacggtgcaggtcactcgcggctggccttagtacttag

SEQ ID NO: 51498 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggccgttgtacttag

SEQ ID NO: 51499 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacaccggatccctcgagagagacgaagtgtttgtccccaagatgaagtcagacatcaagtggtacggcaagtacctcaacaaccctttgggacgcaccgtgatgttaacgtttcagttcactctcggctggcctttgtacttag

SEQ ID NO: 51500 - DNA, 357 bp, Artificial
  Mutation in BnaA.FAD2.a introduced by TALE nuclease pair BnFAD2_T07
cctctcctccctcaccctctcccttacctcgcctggcccctctcctgggcctgccaaggctgcgtcctaacgggcctctgggtcatcgcccacgaatgcaccacgccttcagcgaccaccagtggctggacgacaccgtcggtctcatcttccactccttcctcctcgtcccttacttctactggaagtacagtcatcgacgccaccattccaacactggctccctcgagagagacgaagtgtttgtccccaagaagaagtcagacatcaagtggtacggcaagtacctcagcaaccctttgggacgcaccgtgatgttaacggttcagttcactctcggctggcctttgtacttag

SEQ ID NO: 51501 - DNA, 407 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggcgcctgcttgccgccatcgtggctggcgatggccaccacctgctccccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51502 - DNA, 346 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgcgtcctaacaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactta

SEQ ID NO: 51503 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagtgcggaccacgccttcagcgactaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51504 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51505 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggctggactacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51506 - DNA, 360 bp, Artificial
  Mutation in BnaA.FAD2.a introduced by TALE nuclease pair BnFAD2_T07
cctctcctccctcaccctctcccttacctcgcctggccactctactgggcctgccaaggctgcgtcctaacgggcctctgggtcatcgcccacgaatgcgccaccacgccttcagcgaccaccagtggctggacgacaccgtcgacctcatcttccactccttcctcctcgtcccttacttctcctggaagtacagtcatcgacgccaccattccaacactggctccctcgagagggatgaagtgtttgtccccaagaagaaatccgacatcaagtggtacggcaagtacctcaacaaccttgtgggacgcaccgggaggttaacggttcagttcactctcggcgggccagtgtacttag

SEQ ID NO: 51507 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51508 - DNA, 352 bp, Artificial
  Mutation in BnaA.FAD2.a introduced by TALE nuclease pair BnFAD2_T07
cctctcctccctcaccctctcccttacctcgcctggcctctctactgggcctgccaagggtgcgtcctaaccggcgtctgggtcatagcccacgagcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51509 - DNA, 299 bp, Artificial
  Mutation in BnaA.FAD2.a introduced by TALE nuclease pair BnFAD2_T07
cctctcctccctcaccatctctcctacttcgcctggcctccaccacgccttcagcgactaccagtggcttgacgacaccgtcggcctcatcttccactccttcctcctcgtcccttacttctcctggaagtacagtcaacgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51510 - DNA, 358 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtgcgaccacgccttcagcgactaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51511 - DNA, 358 bp, Artificial; identical to SEQ ID NO: 47324
  Mutation in BnaA.FAD2.a introduced by TALE nuclease pair BnFAD2_T07

SEQ ID NO: 51512 - DNA, 407 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcgcctgcttgccgccatcgtggctggcgatggccaccacctgctccccaccacgccttcagcgactaccagtggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51513 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51514 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcacgtggtacggcaagtacctcaacaaccgtttgggacgcaccgtgatgttaacggttcagttcactctcggctggcctttgtacttag

SEQ ID NO: 51515 - DNA, 358 bp, Artificial
  Mutation in BnaA.FAD2.a introduced by TALE nuclease pair BnFAD2_T07
cctctcctccctcaccctctcccttacctcgcctggcccctctactgggcctaccaaggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51516 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcccaccacgccttcagctactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51517 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccaccacgccttcagcgactaccagtggctggacgacaccgtcggcctcatcttccactccttcctcctcgtcccttacttctcctggaagtacagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51518 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccacacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51519 - DNA, 376 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgcggcaaacaaaccaccgctcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51520 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacagtgatgttaacggttcagttcactctcggctggcctttgtacttag

SEQ ID NO: 51521 - DNA, 353 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 51522 - DNA, 356 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacagcccgttgggacgcaccgtgatgttaacggttcagttcactctcggctggccttgtacttag

SEQ ID NO: 51523 - DNA, 320 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51524 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccaaccacgccttcagcgactaccagtggctggacgacaccgtcggcctcatcttccactccttcctcctcgtaccttacttctcctggaagtacagtcatcgacgccaccattccaacactggctccctcgagagagacgaagtgtttgtccccaagaagaagtcagacatcaagtggtacggcaagtacctcagcatccctttgggacgcaccgtgatgttaacggttcagttcactctcggctgccctttgtacttag

SEQ ID NO: 51525 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51526 - DNA, 390 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgagtgcggacaatggtgacttctacagcgcggagaatcttccactccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51527 - DNA, 387 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggtggcaagcaggcgcgggagacggtgcggaccacgccttcagcaaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51528 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51529 - DNA, 386 bp, Artificial
  Mutation in BnaA.FAD2.a introduced by TALE nuclease pair BnFAD2_T07
cctctcctccctcaccctctctcctacttcgcctggcctctctactcggcctgccaaggctgcgtcctaacgggcctctgggtcatcgcccacgaatgcgatcgagatcgcccggcacagcacccaccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51530 - DNA, 362 bp, Artificial; identical to SEQ ID NO: 46163
  Mutation in BnaA.FAD2.a introduced by TALE nuclease pair BnFAD2_T07

SEQ ID NO: 51531 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 51532 - DNA, 265 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51533 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctccacaaccctttgggacgcaccgtgatgttaacgtgtcagtacactctcggctggcctttggacttag

SEQ ID NO: 51534 - DNA, 342 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51535 - DNA, 358 bp, Artificial
  Mutation in BnaA.FAD2.a introduced by TALE nuclease pair BnFAD2_T07
cctctcctccctcaccctctctcctacttcgcctggcatctctaatgggcctgccagggctgcgtcctaaccggcgtctgggtcatagcccacgagtgccaccacgccttcagcgactaccagtggctggacgacaccgtcggccgcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcacgcgcggctgccctgagtacttag

SEQ ID NO: 51536 - DNA, 359 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgctaaccgtccagttcacgctcggctggcctttgtacttag

SEQ ID NO: 51537 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgactaccagtggctggacgacaccgtcggcctcatcttccactccttcctcctcgtcccttacttctcctggaagtacagtcatcgacgccaccattccaacactggctccctcgagagagacgaagcgtttgtccccaagaagaagtcagacatcaagtggtacggcaagtacctcaacaaccctttgggacgcaccgtgatgttaacggttcagttcactctcggctggcctttgtacttag

SEQ ID NO: 51538 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgtcctttgtacttag

SEQ ID NO: 51539 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51540 - DNA, 356 bp, Artificial
  Mutation in BnaA.FAD2.a introduced by TALE nuclease pair BnFAD2_T07
cctctcctccctcaccctctcccttacctcgcctggccactctactgggcctgccaaggctgcgtcctaacgggcctctgggtcatcgcccacgaatgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctgtgtacttag

SEQ ID NO: 51541 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgcaccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagatatcaagtggtacggcaagtacctcaacaaccctttgggacgcaccgtgatgttaacggttcagttcactctcggctggcctttgtacttag

SEQ ID NO: 51542 - DNA, 357 bp, Artificial
  Mutation in BnaA.FAD2.a introduced by TALE nuclease pair BnFAD2_T07
cctctcctccctcaccctctctcctacttcgcctggcatctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacatccctttgggacgcaccgtgaggttaacggttcagttcacgctcggctggccttagtacttag

SEQ ID NO: 51543 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacgtag

SEQ ID NO: 51544 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcctcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctgtgtacttag

SEQ ID NO: 51545 - DNA, 425 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccagcggcggaggaactctttgatccggttcctgaacaccgtgggctcccccatcgactacggcgtaccacgccttcagcgaccaccagtggctggacgacgccgtgggcctcgtcttccactccttcctcctcgtcccttacttctccttgaagtacagtcatcgacgccaccattccaacactggctccctcgagagagacgaagtgtttgtccccaagaagaagtcagacatcaagtggtacggcaagtacctcaacaaccctttgggacgcaccgtgatgttatcggtgcagttgactctcggctggcctttgtacgtag

SEQ ID NO: 51546 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgaggctaaccgtccagttcacgctcggctggcctttgtacttag

SEQ ID NO: 51547 - DNA, 361 bp, Artificial; identical to SEQ ID NO: 47463
  Mutation in BnaA.FAD2.a introduced by TALE nuclease pair BnFAD2_T07

SEQ ID NO: 51548 - DNA, 378 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtcgttcggctgcggcgagcggtataccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51549 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgactaccagtggttggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51550 - DNA, 358 bp, Artificial
  Mutation in BnaA.FAD2.a introduced by TALE nuclease pair BnFAD2_T07
cctctcctccctcaccctctctactacttcgcctggcctctctactgggcctgccaagggtgcgtcctaaccggcgtctgggtcatagcccacgagtgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacgaccctttgggacgcaccgtgatgtttacggttcagttcacgctcggctggcctttgtacttag

SEQ ID NO: 51551 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatcgcccacgagtgccaccacgccttcagcgaccaccagtggctggacgacgccgtgggcctcgtcttccactccttcctcctcgtcccttacttctcctggaagtacagtcatcgacgccaccattccaacactggctccctcgaaagagacgaagtgtttgtccccaagaagaagtcagacatcgagtgatccggcaagtccctcaatatccttatgggacgccctgtactgttaacggttcagttcaccctcggctggcctttgtacttag

SEQ ID NO: 51552 - DNA, 352 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaatcggcgtctaggtcatagcccacgagtgtgccttcagcgactaccagtggctggacgacaccgtcggcctcatcttccactccttcctcctcgtcccttacttctcctggaagtacagtcgtcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51553 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 51554 - DNA, 358 bp, Artificial; identical to SEQ ID NO: 46796
  Mutation in BnaA.FAD2.a introduced by TALE nuclease pair BnFAD2_T07

SEQ ID NO: 51555 - DNA, 376 bp, Artificial
  Mutation in BnaA.FAD2.a introduced by TALE nuclease pair BnFAD2_T07
cctctcctccctcaccctctctcctacctcgcctggcccctctactgggcctgccaaggctgcgtcctaacgggcctctgggtcatcgcccacgaatgcggcaaacaaaccaccgctcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51556 - DNA, 359 bp, Artificial
  Mutation in BnaA.FAD2.a introduced by TALE nuclease pair BnFAD2_T07
cctctcctccctcaccctctctcctacttcgcctggcctctccactgggcctgccagggctgcgtcctaaccggcgcctgggtcatagcccacgagtgcggaccacgccttcagcgactaccagtggcttgacgacaccgtaggtctcatcttccactccttcctcctcctcccttacttctccgggaagtacagtcatcgacgccaccattccaacactggctccatcgagagagacgaagtgtttgtccccaagaagaagtcagacatcaagtggtacggcaagtacctcaacagccctttgggacgcaccgtgatgttaaccgttcaattcacgctcggctggcctttgtgcctag

SEQ ID NO: 51557 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgcccccattccaacactggctccctcgagagagacgaagtgtttgtccccaagaagaagtcagacatcaagtggtacggcaagtacctcaacaaccctttgggacgcaccgtgatgttaacggttcagttcactctcggctggccttagtacttag

SEQ ID NO: 51558 - DNA, 258 bp, Artificial
  Mutation in BnaA.FAD2.a introduced by TALE nuclease pair BnFAD2_T07
cctctcccccctcaccctctcccttacctcgcctggcccctctactgggcctgccaaggctgcgtcctaacgggcctctgggtcatcgcccacgaatgcggcaccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51559 - DNA, 363 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggcccaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51560 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaataccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51561 - DNA, 387 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggtggcaagcaggcgctggagacggtgcggaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51562 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctaatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaacggttcagttcactctcggctggcctttgtacttag

SEQ ID NO: 51563 - DNA, 348 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacaccaagtggtacggcaagtacctcaacaccccttggggacgcaccgggatgttaacggttcagttcacgctgggcgggcttttgtattag

SEQ ID NO: 51564 - DNA, 355 bp, Artificial; identical to SEQ ID NO: 46157
  Mutation in BnaA.FAD2.a introduced by TALE nuclease pair BnFAD2_T07

SEQ ID NO: 51565 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccgccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51566 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccaccacgccttcagcgactaccagtggcttggcgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51567 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51568 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51569 - DNA, 340 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgcctgggtcaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgttatgttaacggttcagttcactctcggctggcctttgtacttag

SEQ ID NO: 51570 - DNA, 358 bp, Artificial; identical to SEQ ID NO: 46889
  Mutation in BnaA.FAD2.a introduced by TALE nuclease pair BnFAD2_T07

SEQ ID NO: 51571 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51572 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaagggtgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51573 - DNA, 330 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcttgacgacaccgtcggtctcatcttccactccttcctcctcgtcccttacttctcctggaagtacagtcatcgacgccaccattccaacactggctccctcgagagagacgaagtgtttgttcccaagaagaagtcagacatcaagtggtacgacaagtacctcaacaaccctttgggacgcaccgtgatgttaacggttcagttcactctcggctggcctttgtacttag

SEQ ID NO: 51574 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51575 - DNA, 421 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggccaccaccaataatggtggcaagcaggcgctggagacggtccagcggctgttgccggtgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51576 - DNA, 354 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51577 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttcactctcggctggcctttgtacttag

SEQ ID NO: 51578 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 51579 - DNA, 359 bp, Artificial; identical to SEQ ID NO: 46605
  Mutation in BnaA.FAD2.a introduced by TALE nuclease pair BnFAD2_T07

SEQ ID NO: 51580 - DNA, 324 bp, Artificial
  Mutation in BnaA.FAD2.a introduced by TALE nuclease pair BnFAD2_T07
cctctcctccctcaccctctctcctacttcgcctggcctctctactgggcctgtcagggctgcgtctaccacgccttcagcgactaccagtggcttgacgacaccgtcggtctcatcttccactccttcccctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacgtttcagttcactctcggctggcctgtgtacttag

SEQ ID NO: 51581 - DNA, 354 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51582 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51583 - DNA, 364 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51584 - DNA, 353 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgaaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcacgctcggctggcctttgtacttag

SEQ ID NO: 51585 - DNA, 354 bp, Artificial
  Mutation in BnaA.FAD2.a introduced by TALE nuclease pair BnFAD2_T07
cctctcctccctcaccctctctcctacttcgcctggcctctctactgggccgccagggctgcgtcctaaccggcgtctgggtcatagcccacgagtaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51586 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctacctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51587 - DNA, 363 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggccgtggtacttag

SEQ ID NO: 51588 - DNA, 375 bp, Artificial
  Mutation in BnaA.FAD2.a introduced by TALE nuclease pair BnFAD2_T07
cctctcctccctcaccctctctcctacttcgcctggcctctctaatgggcctgccaagggtgcgtcctaaccagcaggtggtgaccatcgccagcaatggcggtggcaacagcccctaccccgccttcaacgaccaccagtggctggacgacgccgtgggcctcgtcttccactccttcctcctcgtcccttacttctccgggaagtacagccatcgacgccaccatgccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 51589 - DNA, 360 bp, Artificial
  Mutation in BnaA.FAD2.a introduced by TALE nuclease pair BnFAD2_T07
cctctcctccctcaccctctctcctacttcgcctagcccctctactgggcctgccaaggctgcgtcctaacgggcctctgggtcatcgcccacgaatgcgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 51590 - DNA, 342 bp, Artificial
  Mutation in BnaA.FAD2.a introduced by TALE nuclease pair BnFAD2_T07
cctctcctccctcaccctctctcctacttcgcctggcctctctattgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctagcctttgtacttag

SEQ ID NO: 51591 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcaggcatcaagtggtacggcaagtacctcaacaaccctttgggacgcaccgtgatgttaacggttcagttcactctcggctggcctttgtacttag

SEQ ID NO: 51592 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51593 - DNA, 363 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggcccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51594 - DNA, 357 bp, Artificial
  Mutation in BnaA.FAD2.a introduced by TALE nuclease pair BnFAD2_T07
cctctcctccctcaacctctctcctacttcgcctggcctctctactgggcctgccaaggctgcgtcctaacgggcctctgggtcatcgcccacgaatgccaccacgccttcagcgaccaccagtggctggacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtactta

SEQ ID NO: 51595 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaataccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 51596 - DNA, 327 bp, Artificial
  Mutation in BnaA.FAD2.a introduced by TALE nuclease pair BnFAD2_T07
cctctcctccctcaccctctctcctacttcgcctggcccctctactgggcctgccagggctgcgtcctaaccacgccttcagcgactaccagtggctggacgacaccgtcggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51597 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtcggccaccacgccttcagcgactaccagtggctggacgacaccgtcggcctcctcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 51598 - DNA, 406 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgctgctggcgatggccaccacctgctggggggtcaagccgtgggcctggccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51599 - DNA, 409 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgtgccaagcccatgcatgcactgacgggtgccccgctcaacttgaccccggagcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51600 - DNA, 331 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatggctggacgacgccgtgggcctcgtcttccactccttcctcctcgtcccttacttctcctggaagtacagtcatcgacgccaccattccaacactggctccatcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51601 - DNA, 395 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgtgggccttgcacagcaccggcaacagccgctggacggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgattttaacggttcagttcactctcggctggcctttgtacttag

SEQ ID NO: 51602 - DNA, 357 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtgcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51603 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51604 - DNA, 344 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgggctaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51605 - DNA, 356 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51606 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 51607 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgagtgcggaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51608 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatgttaacggttcagttcactctcggctggcctttgtacttag

SEQ ID NO: 51609 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcaccacgccttcagcgactaccagtggctggacgacacagtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51610 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaaccggcgtctgggtcatagcccacgagtgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51611 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgctaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51612 - DNA, 363 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggcccaccacgccttcagcgactaccagtggctggacgacaccgtcggcctcatcttccactccttcctcctcgtcccttacttctcctggaagtacagtcatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51613 - DNA, 317 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtccttcagcgactaccagtggctggacgacaccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51614 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51615 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51616 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51617 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtaccacgccttcagcgaccaccagtggctggacgacgccgtgggcctcgtcttccactccttcctcctcgtcccttacttctcctggaagtacagtcatcgacgccaccattccaacactggctccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51618 - DNA, 406 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggagcggatttgaacgttgtgaagcaacggcccggagggtggcgggcgtaccacgccttcagcgactaccagtggcttgacgacaccgtcggtctcatcttccactccttcatcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51619 - DNA, 350 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaaccggcgtctgggtcatagcctaaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51620 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgctaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgtgacgcaccgtgatgttaacggttcagttcactctcggctggcctttgtacttag

SEQ ID NO: 51621 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaagggtgcgtcctaaccggcgtctgggtcatcgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51622 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51623 - DNA, 356 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtcaccacgcctttagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51624 - DNA, 353 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgacgccttcagcgactaccagtggctggacgacaccgtcagcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaaccctttgggacgcaccgtgaggttaacggggcagttcactctcggctggcctttgtacttag

SEQ ID NO: 51625 - DNA, 364 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgtgacgcaccgtgatgttaacgggtcagttcactctcggctggcttttgtacttag

SEQ ID NO: 51626 - DNA, 342 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51627 - DNA, 331 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51628 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctaggctggcctttgtacttag

SEQ ID NO: 51629 - DNA, 355 bp, Artificial
  Mutation in BnaA.FAD2.a introduced by TALE nuclease pair BnFAD2_T07
cctctcctccctcaccctctcccttacctcgcctggaccctctactgggcctgccaaggctgcgtcctaacgggcctctgggtcatcgcccacgaataccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 51630 - DNA, 358 bp, Artificial
  Mutation in BnaA.FAD2.a introduced by TALE nuclease pair BnFAD2_T07
cctctcctccctcaccctctcccttacctcgcctggtccctctactgggcctgccaaggctgcgtcctaacgggcctctgggtcatcgcccacgaatgcgaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51631 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51632 - DNA, 358 bp, Artificial
  Mutation in BnaA.FAD2.a introduced by TALE nuclease pair BnFAD2_T07
cctctcctccctcaccctctctcctacctcgcctggcccctctactgggcctgccaaggctgcgtcctaacgggcctctgggtcatcgcccacgaatgctaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51633 - DNA, 340 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcctctgggtcatcgccttcagcgacgaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51634 - DNA, 357 bp, Artificial
  Mutation in BnaA.FAD2.a introduced by TALE nuclease pair BnFAD2_T07
cctctcctccctcaccctctcccttacctcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcagcaaccctttgtgacgcaccgtgaggttaacggttcagttcactctcggctggcctttggacttag

SEQ ID NO: 51635 - DNA, 258 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcggcaccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51636 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctagtacgcacggtgatgctaaccgtccagttcactctcggctggccgttgtacttag

SEQ ID NO: 51637 - DNA, 347 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgaaccgtgatgttaacggttcagttcactctcgcctggcctttgtacgtag

SEQ ID NO: 51638 - DNA, 355 bp, Artificial
  Mutation in BnaA.FAD2.a introduced by TALE nuclease pair BnFAD2_T07
cctctcctccctcaccctctctcctacttcgcctgtcctctctactgggcctgccaagggtgcgtcctaacctgcgtctgggtcatagcccacgagtaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51639 - DNA, 452 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggccatcctgacggtgatcagccactggtaacaggattagcagagcgaggtatgtaggcggtgctacagagttcttgaagtggtggcctaaggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51640 - DNA, 404 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggccaccacctgctggggggtcaagccgtgggcctggcacagcaccggcaacgccttcagcgactaacagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51641 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtaccacgccatcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51642 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcatcgtgatgttaacggttcagttcactctcggctggcctttgtacttag

SEQ ID NO: 51643 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcccaccacgccttcagcgactaccagtggcttgacgacgccgtgggcctcctcttccactccttcctcctcgtcccttacttctcctggaagtacagtcatcgacgccaccattccaacactggctccctcgagagagacgaagtgttcgtccccaagacgaagtcagacatcaagtggtacggcaagtacctcaacaaccctttgggacgcaccgtgatgttaacggttcagttcactctcggctggcctttgtacttag

SEQ ID NO: 51644 - DNA, 359 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcccaccacgccttcatcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcatttgtacttag

SEQ ID NO: 51645 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccatttcaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51646 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtattag

SEQ ID NO: 51647 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51648 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacggtcatcgacgccaccattccaacactggctccctcgagggagacgaagtgtttgtccccaagaagaaggcagacatcaagtggtacggcaagtaccgcaacaaccctttggagcgcaccgtgatgttaatcggagatttctctctcggctggccgttgtacttag

SEQ ID NO: 51649 - DNA, 358 bp, Artificial; identical to SEQ ID NO: 47626
  Mutation in BnaA.FAD2.a introduced by TALE nuclease pair BnFAD2_T07

SEQ ID NO: 51650 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgaatgcgccaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51651 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaacacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51652 - DNA, 355 bp, Artificial
  Mutation in BnaA.FAD2.a introduced by TALE nuclease pair BnFAD2_T07
cctctcctccctcaccctctctcctacttcgcctggcccctctactgggcctgccaaggctgcgccctaacgggcctctgggtcatcgcccacgaatatcacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacagttcagttcactctcggctggcctttgtacttag

SEQ ID NO: 51653 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgcaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51654 - DNA, 314 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51655 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtact

SEQ ID NO: 51656 - DNA, 341 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccataaatagccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51657 - DNA, 341 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccataaatagccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacttcaagtggtacggcaagtacctcaacaaccctttgggacgcaccgtgatgttaacggttcagttcactctcggctggcctttgtacttag

SEQ ID NO: 51658 - DNA, 364 bp, Artificial
  Mutation in BnaA.FAD2.a introduced by TALE nuclease pair BnFAD2_T07
cctctcctccctcaccctctctcctacttcgtgtggcctctctactgggcctgccaagggtgcgtcctaaacggcgtctgggtcatagcccacgagtgcgtgcctaaccacgccttcagcgactaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgggatgttaacggttcagttcactcgcggctggcctttgtacttag

SEQ ID NO: 51659 - DNA, 364 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcggccaccacgccttcagcgaccaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 51660 - DNA, 309 bp, Artificial
  Mutation in BnaA.FAD2.a introduced by TALE nuclease pair BnFAD2_T07
cctctcctccctcaccctctctcctacttcgcctggcctctctactgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51661 - DNA, 354 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttctctctcggctggcctttgtacttag

SEQ ID NO: 51662 - DNA, 360 bp, Artificial
  Mutation in BnaA.FAD2.a introduced by TALE nuclease pair BnFAD2_T07
cctctcctccctcaccctctcccttacctcgcctggcctctctactgggcctgccaagggtgcgtcctaaccggcgtctgggtcatagcccacgagtgcgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51663 - DNA, 358 bp, Artificial
  Mutation in BnaA.FAD2.a introduced by TALE nuclease pair BnFAD2_T07
cctctcctccctcaccctctctcctacttcgcatggcctctctactgggcctgccaagggtgcgtcctaaccggcgtctgggtcatagcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggtgcagttcactctcggctggcctttgtacttag

SEQ ID NO: 51664 - DNA, 356 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51665 - DNA, 265 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtgcagtcatcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctttgtacttag

SEQ ID NO: 51666 - DNA, 353 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51667 - DNA, 363 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtgggcctcgtcttccactccttcctcctcgtcccttacttctcctggaagtacagccatcgacgccaccattccaacaccggctccctcgagagagacgaagtgtttgtccccaagaagaagtcagacatcaagtggtacggcaagtacctcaacaaccctttggggcgcaccgtgatgttaacggttcagttcactctcggctggcctttgtacttag

SEQ ID NO: 51668 - DNA, 417 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggtggtggcactgacgggtgccccgctcaacttgaccccggagcaggtggtggccatcgtaccacgccttcagcgactaccagtgactggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaactggtacggcaagtacctcaacaaccctttgggacgcaccgtgatgttaacggttcagttcactctcggctggcctttgtacttag

SEQ ID NO: 51669 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcacgctcggctggcctttgtacttag

SEQ ID NO: 51670 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgagtgcgccaccacgccttcagcgactaccagtggctggacgacgccgtgggcctcgtcttccactccttcctcctcgtcccttacttctcctggaagtacagccatcgacgccaccattccaacactggctccctcgagggagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51671 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaattacctcaacaaccctgtgggacgcaccgggatgctaacggttcagttcactctcggctggcctttgtacttag

SEQ ID NO: 51672 - DNA, 258 bp, Artificial
  Mutation in BnaA.FAD2.a introduced by TALE nuclease pair BnFAD2_T07
cctctcctccctcaccctctcacctacttcgcctggcccctctactgggcctgccagggctgcgtcctaacgggcctctgggtcatcgcccacgaatgcggccccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51673 - DNA, 342 bp, Artificial
  Mutation in BnaA.FAD2.a introduced by TALE nuclease pair BnFAD2_T07
cctctcctccctcaccctctctcctacttcgcctggcctctctattgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51674 - DNA, 363 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggggccaccacgccttcagcgaccaccagtggctggacgacgccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggtgcagttcactctcggctggcctttgtacttag

SEQ ID NO: 51675 - DNA, 368 bp, Artificial
  Mutation in BnaA.FAD2.a introduced by TALE nuclease pair BnFAD2_T07
cctctcctccctcaccctctctcatacttcgcctggcccctctactgggcctgccaaggctgcgtcctaacgggcctctgggtcatcgcccacgaatatctttggtgaccgtaacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51676 - DNA, 348 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgctaccacgacttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 51677 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcacggtgatgctaaccgtccagttcacgctcggctggcctttgtacttag

SEQ ID NO: 51678 - DNA, 362 bp, Artificial
  Mutation in BnaA.FAD2.a introduced by TALE nuclease pair BnFAD2_T07
cctctcctccctcaccctatctcctacttcgcctggcctctctactgggcctgccagggctgcgtcctaaccggcgtctgggtcatagcccacgagtgcggccaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51679 - DNA, 343 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgatgaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51680 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggcctcatcttccactccttcctcctcgtcccttacttctcctggaagtacagtcatctacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51681 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51682 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtattag

SEQ ID NO: 51683 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgggacgcaccgtgatgttaacggttcagttcactctcggctggcctttgtacttag

SEQ ID NO: 51684 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgactaccagtggttggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51685 - DNA, 347 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51686 - DNA, 258 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcggcaccaccattccaacaccggatccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 51687 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51688 - DNA, 346 bp, Artificial
  Mutation in BnaA.FAD2.a introduced by TALE nuclease pair BnFAD2_T07
cctctcctccctcaccctgtcccttacctcgcctggcctctctactgggcctgccaagggtgcgtcctaaccggcgtctgggtcatagcccacgccttcagcgactaccagtggctggacgacaccgtccgcctcatcttccactccttcctcctcgtcccttccttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51689 - DNA, 265 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcagtcatcgacgccaccattccaacactggctccctcgagagagactaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51690 - DNA, 265 bp, Artificial
  Mutation in BnaA.FAD2.a introduced by TALE nuclease pair BnFAD2_T07
cctctcctccctcaccctatcccttacctcgcctggcccctctactgggcctgccaaggctgcgtcctaaccggcgtctgggtcatagcccacgagtgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51691 - DNA, 360 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgagtgcgttaccacgccttcagcgactaccagtggctggacgacaccgtcggcctcatcttccactccttcctcctcgtcccttacttctcctggaagtacagccatcgacgccaccattccaacaccggatccctcgagagtgatgaagtgttcgtccccaagaagaaatccgacatcaagtggtacggaaagtacctcaacatcccttggggacgcaccgtgatgttaacggttcagttcactctcggctggcctttgtacttag

SEQ ID NO: 51692 - DNA, 355 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaataccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51693 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcatttgtacttag

SEQ ID NO: 51694 - DNA, 354 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcacgccttcagcgactaccagtggcttgacgacaccatcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51695 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccttcagcgactaccagtggctggacgacaccgtcggcctcatcttccactccttcctcctcgtcccttacttctcctgtaagtacagtcatcgacgccaccattccaacactggctccctcgagagagacgaagtgtttgtccccaagatgaagtcagacatcaagtggtacggcaagtacctcaacagcccgttgggacgcaccgtgatgttaacggttcagttcactctcggctggcctttgtacttag

SEQ ID NO: 51696 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtaaggcaagtacctcaacaaccctttgggacgcaccgtgatgttaacggttcagttcactctcggctggcctttgtacttag

SEQ ID NO: 51697 - DNA, 390 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggacaatggtgacttctacagcgcggagaatcttccactccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggtgcagttcactctcggctggccgttgtacttag

SEQ ID NO: 51698 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51699 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgacaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51700 - DNA, 358 bp, Artificial
  Mutation in BnaA.FAD2.a introduced by TALE nuclease pair BnFAD2_T07
cctctcctccctcaccctctctcctacttcgcctggcctctctactgcgcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaaccgtccagttcacgctcggctggcctttgtacttag

SEQ ID NO: 51701 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgaggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctctgggacgcaccgtgatgttaacggttcagttcactctcggcgggcctttgtacttag

SEQ ID NO: 51702 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgcgatgaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51703 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggaaagtacctcaacaacccgctaggacgcaccgtgatgttaacggttcagttcactctcggctggcctttgtacttag

SEQ ID NO: 51704 - DNA, 350 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51705 - DNA, 465 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgtgtccagcgcctgcttgccgccatcgtggctggcgatggccaccacctgctccggggttaagccgtgggcctggcacagcaccggcaacagccgctggaccgtctccaccacgccttcagcgaccaccagtggctggacgacgccgtgggcctcgtctcccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51706 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgacctttgtacttag

SEQ ID NO: 51707 - DNA, 446 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcggtggcaagcaggggctggagacggtcccggggctgttgccggtgctgtgccaggcccacggcttgaccccggagcaggcggtgccaccacgccttccgcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51708 - DNA, 298 bp, Artificial
  Mutation in BnaA.FAD2.a introduced by TALE nuclease pair BnFAD2_T07
cctctcctccctcaccctatcccttacctcgcctggcccctctactgggcctgccaaggctgcgtcctaacgggcctctgggtcatcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51709 - DNA, 409 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgtgccaggcccatgcatgcactgacgggggccccgctcaacttgaccccggagcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51710 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51711 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51712 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51713 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51714 - DNA, 342 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtcctaaccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51715 - DNA, 359 bp, Artificial
  Mutation in BnaA.FAD2.a introduced by TALE nuclease pair BnFAD2_T07
cctctcctccctcaccctctcccttacctcgcctggcccctctactcggcctgccaaggctgcgtcctaacgggcctctgggtcatcgcccacgaatgcggaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtccctcaacaaccctgttggacgcaccgtgatgttaaccgttcagttcactctcggctggcctttgtacttag

SEQ ID NO: 51716 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgatgctaaccgtgcagttcacgctcggctggcctttgtacttag

SEQ ID NO: 51717 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51718 - DNA, 365 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggtcggccaccacgccttcagcgactaccagtggctggacgacaccgtcggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51719 - DNA, 378 bp, Artificial
  Mutation in BnaA.FAD2.a introduced by TALE nuclease pair BnFAD2_T07
cctctcctccctcaccctgtcccttacctcgcctggcccctctactgggcctgccaagggtgcgtcctaaccggcgtctgggtcatagcccacgagtcgttcggctgcggcgagcggtataccacgccttcagcgactaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaactgttcagttcactctcgtctggcctttgtgcttag

SEQ ID NO: 51720 - DNA, 345 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgattcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51721 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 51722 - DNA, 299 bp, Artificial
  Mutation in BnaA.FAD2.a introduced by TALE nuclease pair BnFAD2_T07
cctctcctccctcaccctctcccttacctcggctggcctccaccacgccttcagcgactaccagtggcttgacgacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaacccttttggacgcaccgtgatgttaacggttcagttcactctcggctggcctttgtacttag

SEQ ID NO: 51723 - DNA, 365 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggtcggtcaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctgtgggacgcaccgtgatgttaacggttcagttcactctcggctggcctttgtacttag

SEQ ID NO: 51724 - DNA, 355 bp, Artificial
  Mutation in BnaA.FAD2.a introduced by TALE nuclease pair BnFAD2_T07
cctctcctccctcaccctttaacctacttcgcctggcatctctcctgagcctgccagggatgcgccccacccggcgtctgggtcatagcccacgagtaccacgcctacagagactaccagtggctggacgacaccgtcggcctcatcttccactcctccctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctagaacgcacggtgatgctaaccgtgcagttcacgctcgcccggccttagtacttag

SEQ ID NO: 51725 - DNA, 358 bp, Artificial
  Mutation in BnaA.FAD2.a introduced by TALE nuclease pair BnFAD2_T07
cctctcctccctcaccctctctcctacttcgcctggcctctctactcggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtactgag

SEQ ID NO: 51726 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctgtgtacttag

SEQ ID NO: 51727 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtcccaaagaagaagtcagacatcaagtggtacggcaagtacctcaacaaccctttgggacgcaccgtgatgttaacggttcagttcactctcggctggcctttgtacttag

SEQ ID NO: 51728 - DNA, 357 bp, Artificial
  Mutation in BnaA.FAD2.a introduced by TALE nuclease pair BnFAD2_T07
cctctcctccctcaccctatctcctacttcgcctggcctctctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaacccgacatcaagtggtacggcaagtacctcaacaaccctttgggacgcaccgtggtgttaacggttcagttcactctcggctggcctttgtacttag

SEQ ID NO: 51729 - DNA, 358 bp, Artificial
  Mutation in BnaA.FAD2.a introduced by TALE nuclease pair BnFAD2_T07
cctctcctccctcaccctctctcctacttcgcctggcctctctcctgggcctgccaagggtgcgtcctaaccggcgtctgggtcatagcccacgagtgccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttggcacgcaccgtgaggttaacggttcagttcactctcggctggcctttgtacttag

SEQ ID NO: 51730 - DNA, 417 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggtggtggcactgacgggtgccccgctcaacttgaccccggagcaggtggtggccatcgtaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51731 - DNA, 355 bp, Artificial
  Mutation in BnaA.FAD2.a introduced by TALE nuclease pair BnFAD2_T07
cctctcctccctcaccctgtctcctacttcgcctggcctctctactgggcctgccagggctgcgtcctaaccggcgtccgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggctggcctttgtacttag

SEQ ID NO: 51732 - DNA, 282 bp, Artificial
  Mutation in BnaA.FAD2.a introduced by TALE nuclease pair BnFAD2_T07
cctctcctccctcaccctctctcctacacgctttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaaccctttgggacgcaccgtgatgttaacggttcagttcactctcggctggcctttgtacttag

SEQ ID NO: 51733 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgccaccacgccttcagctactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 51734 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtactgcaagtacctcaacaaccctttgggacgcaccgtgatgttaacggttcagttcactctcggctggcctttgtacttag

SEQ ID NO: 51735 - DNA, 342 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51736 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51737 - DNA, 282 bp, Artificial
  Mutation in BnaA.FAD2.a introduced by TALE nuclease pair BnFAD2_T07
cctctcctccctcaccctctctccaccacaccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51738 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgctaccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 51739 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcggccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51740 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcgtctgggtcatagcccacgagaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 51741 - DNA, 350 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgaacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51742 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatcgcccacgaatgaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51743 - DNA, 331 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatggctggacgacgccgtgggcctcgtcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51744 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgttgtgacgcaccgtgatgttaacggttcagtgcactctcgggtggcctttgtacttag

SEQ ID NO: 51745 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgactaccagtggttggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttagggacgcaccgtgatgttaacggttcagttcactctcggctggcctttgtacttag

SEQ ID NO: 51746 - DNA, 354 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggccttggtacttag

SEQ ID NO: 51747 - DNA, 357 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaaccggcgtctgggtcatagcccacgagtgtaccacgccttcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51748 - DNA, 359 bp, Artificial
  Mutation in BnaA.FAD2.a introduced by TALE nuclease pair BnFAD2_T07
cctctcctccctcaccctctctcctacttcgcctggcctctctcctgggcctgccagggctgcgtcctaaccggcgtctgggtcatagcccacgagtgcgcaccacgccttcagcgactaccagtggctggacgacaccgtcggcctcatcttccactccttcctcctcctcccttacttctcctggaagtacagtcatcgacgccaccattccaacactggctccctcgagagagacgaagtgtttgtccccaagaagaagtcagacatcaagtggtacggcaagtacctcaacgtccctttgggacgcagcgtggtgttaacggttcagttgcctctcggctggcctttgtacttag

SEQ ID NO: 51749 - DNA, 342 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcgatgaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggaacggcgagtacctcaacaaccctttggtacgcaccgtgatgttaacggttcagttcactctcggctggcctttgtactag

SEQ ID NO: 51750 - DNA, 353 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatcacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51751 - DNA, 355 bp, Artificial; identical to SEQ ID NO: 46124
  Mutation in BnaA.FAD2.a introduced by TALE nuclease pair BnFAD2_T07

SEQ ID NO: 51752 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgaccaccagtggctggacgacgccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51753 - DNA, 348 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgctaccacgacttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51754 - DNA, 362 bp, Artificial
  Mutation in BnaA.FAD2.a introduced by TALE nuclease pair BnFAD2_T07
cctctcctccctcaccctctctcctacttcgcctcgcctctctactgggcctgccagggctgcgtcctaaccggcgtctgggtcatagcccacgagtgcggccaaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51755 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggactcaccgtgatgttaacggttcagttcactctcggcttgcctttgtacttag

SEQ ID NO: 51756 - DNA, 350 bp, Artificial
  Mutation in BnaA.FAD2.a introduced by TALE nuclease pair BnFAD2_T07
cctctcctccctcaccctctcccttacctcgcctggcctctctactgggcctgccaaggctgcgtcctaacgggcctctgggtcatagcccacgagtgcggccagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51757 - DNA, 358 bp, Artificial; identical to SEQ ID NO: 46262
  Mutation in BnaA.FAD2.a introduced by TALE nuclease pair BnFAD2_T07

SEQ ID NO: 51758 - DNA, 352 bp, Artificial
  Mutation in BnaA.FAD2.a introduced by TALE nuclease pair BnFAD2_T07
cctctcctccctcaccctctctcctacttctcctggcctctcctcttggcctgccagggccgcgccctaaccggcgcctgggccatagcccacgagcacgccttcaccgactaccagaggctggacgacaccgtcggcctcaccttccactccttcctcctcgtcccttccttctcctggacgtccagccatccacgccaccattccaacactggctccctcgagagagacgaagtgtttgtacccaagaagaagtcaggcatcaagtgataccgcaagtacccagacatgcctttgggacgcaccgtggtgataaccgctcagttcacgctcggctggcctttgtgcatag

SEQ ID NO: 51759 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51760 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51761 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51762 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggccaccacgccttcagcgaccaccagtggctggacgacgccgtgggcctcgtattccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51763 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51764 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtcttggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaactgttcagttcactctcggctggcctttgtacttag

SEQ ID NO: 51765 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaaggacctcaacaaccctttgggacgcaccgtgatgttaacggttcagttcactctcggctggcctttgtacttag

SEQ ID NO: 51766 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgccaccacgccttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51767 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacaccggatccctcgagagagatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 51768 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtcggcctcatcttccactccttcctcctcgtcccttacttctccttgaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51769 - DNA, 375 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccagcaggtggtggccatcgccagcaatggcggtggcaacagccgctaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51770 - DNA, 343 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgatgaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51771 - DNA, 430 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggctggcgatggccaccacctgctggggggtcaagccgtgggcctggcacagcaccggcaacagccgctggagaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51772 - DNA, 362 bp, Artificial
  Mutation in BnaA.FAD2.a introduced by TALE nuclease pair BnFAD2_T07
cctctcctccctcaccctctcccttacttcgcctggcctctctactgggcctgccagggctgcgtcctaaccggcgtctgggtcatagcccacgaatgcggcccaccactccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacgtcaagtacctcaacagccctttgggacgcaccgtgatgttaacggctcagttcactctcggctggcctttgtacttag

SEQ ID NO: 51773 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51774 - DNA, 355 bp, Artificial
  Mutation in BnaA.FAD2.a introduced by TALE nuclease pair BnFAD2_T07
cctctcctccctcaccctctctcctacttcgcctggcctctctacttggcctgccaaggctgcgtcctaacgggcctctgggtcatcgcccacgaataccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51775 - DNA, 352 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51776 - DNA, 395 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgtgggcctggcacagcaccggcaacagccgctggacggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51777 - DNA, 358 bp, Artificial
  Mutation in BnaA.FAD2.a introduced by TALE nuclease pair BnFAD2_T07
cctctcctccctcaccctctcccttacctcgcctggcaactctactgggcctgccaaggctgcgtcctaacgggcctctgggtcatcgcccacgaatgccaccacgccttcagcgaccaccagtggctggacgacgccgtgggcctcgtcttccactccttcctcctcgtccctttcttctcctggaagtacagccatcgacgccaccattccaacaccggatccctcgagagagacgaagtgtttgtccccaagaagaagtcagacatcaagtggtacggcaagtacctcaacaaccctgtgggacgcaccaggatgttaacggttccgttcactctcggcgggccttggtacgtag

SEQ ID NO: 51778 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtcggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51779 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51780 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgaaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacgtttcagttcactctcggctggcctttgtacttag

SEQ ID NO: 51781 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaaccgtccagttcacgctcggctggcctttgtacttag

SEQ ID NO: 51782 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcggccaaccacgccttcagcgactaccagtggcttgacgacaccgtcgggctcatcttccactccttcctcctcgtcccttacttctcctggaagtacagtcatcgacgccaccattccaacactggctccctcgagagagacgaagtgtttgtccccaagaagaaatccgacatcatgtggtacggaaagtacctcaacaacccgctaggacgcacggtgatgctaaccgtccagttcacgctcggctggcctttgtacttag

SEQ ID NO: 51783 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtgcggcaagtacctcaacaaccctttgggacgcaccgtgatgttaacggttcagttcactctcggctggcctttgtacttag

SEQ ID NO: 51784 - DNA, 340 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcaacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51785 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcgaccacgccttcagcgactaacagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51786 - DNA, 358 bp, Artificial
  Mutation in BnaA.FAD2.a introduced by TALE nuclease pair BnFAD2_T07
cctctcctccctcaccctctctcctacttcgcctggactctctactgggcctgccagggctgcgtcctaaccggcgtctgggtcatcgcccacgaatgccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttttacttag

SEQ ID NO: 51787 - DNA, 356 bp, Artificial
  Mutation in BnaA.FAD2.a introduced by TALE nuclease pair BnFAD2_T07
cctctcctccctcaccctctgtcctacttcgcctggcctctctactgggcctgccaaggctgcgtcctaacgggcctctgggtcatcgcccacgaatgaccacgccttcagcgaccaccagtggctggacgacgccgtgggcctcgtcttccactcattcctcctcgtcccttacttctcctggaagtacagccatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtgcttag

SEQ ID NO: 51788 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgctaccacgccttcagcgaccaccagtggctggacgacgccgtgggcctcgtcttccactccttcctcctcgtcccttacttctcctggaagtacagccatcgacgccacaattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51789 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 51790 - DNA, 281 bp, Artificial
  Mutation in BnaA.FAD2.a introduced by TALE nuclease pair BnFAD2_T07
cctctcctccccaccctatctccaccacgccttcagcgactaacagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcatttctctctcggctggcctttgtgcttag

SEQ ID NO: 51791 - DNA, 409 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgtgccaggcccatgcatgcactgacgcctgccccgctcaacttgaccccggagcaccacgccttcagcgaccaccagtggctggacgactccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51792 - DNA, 431 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagtgcgggcccggagggtggcgggcaggacgcccgccataaactgggcaacaatgctctccagcgccggcctgccggccaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51793 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtaccacgccttcagcgactaccagtggcttgacgacaccgtcggtctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaaccgtccagttcacgctcggctggcctttgtacttag

SEQ ID NO: 51794 - DNA, 346 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgccttcagcgactaccagtggcttgacgacaccgtcggtctcatcttccactccttcctcctcgtcccttacttctcctggaagtacagtcatcgacgccaccattccaacactggctccctcgagagggatgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51795 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccagggatgcgtcctaaccggcgtctgggtcatagcccacgagtgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctaggacgcacggtgaggctaaccgtccagttcacgctctgctggccttagtacttag

SEQ ID NO: 51796 - DNA, 342 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggcgggcctttgtacttag

SEQ ID NO: 51797 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51798 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgacgctaaccgtccagttcacgctcggctggcctttgtacttag

SEQ ID NO: 51799 - DNA, 348 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttagc

SEQ ID NO: 51800 - DNA, 358 bp, Artificial; identical to SEQ ID NO: 47868
  Mutation in BnaA.FAD2.a introduced by TALE nuclease pair BnFAD2_T07

SEQ ID NO: 51801 - DNA, 357 bp, Artificial
  Mutation in BnaA.FAD2.a introduced by TALE nuclease pair BnFAD2_T07
cctctcctccctcaccctctctcctacttcgccttgcctctctactgggcctgccaggtctgcgtcctaaccggcgtctgggtcatagcccacgagtgcaccacgccttcagcgactaccatcggctggacgacaccgtcggcctcatcttccactccttcctcctcgtcccttacttctcctggaagtacagtcatcgacgccaccattccaacactggctccctcgagagagacgaagtgttcgtccccaagaagaaatccgacaacaagtggtacggaaagtacctcaacaacccgctaggacgcgcggggatgctaaccgtccagttcacgctcggctggcatttgtacttag

SEQ ID NO: 51802 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgaaccacgccttcagcgaccaccagtggctggacgacgccgttggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51803 - DNA, 258 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggcaccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtgcttag

SEQ ID NO: 51804 - DNA, 341 bp, Artificial
  Mutation in BnaA.FAD2.a introduced by TALE nuclease pair BnFAD2_T07
cctctcctccctcaccctctctcctacttcgcctggcctctctattgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctgcctttgtacttag

SEQ ID NO: 51805 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatcgcccacgagtaccacgccttcagcgactaccagtggctggacgacgccgtgggcctcatcttccactccttcctcctcgtcccttacttctcctggaagtacagtcatcgacgccaccattccaacactggctccctcgagagagacgaagtgtttgtccccaagaagaagtcagacatcaagtggtacggaaagtacctcaacaacccgctgggacgcaccgtgatgttaacggtccagttcactctcggctggcctttgtacttag

SEQ ID NO: 51806 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51807 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaacgggcctctgggtcatcgcccacgaatgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51808 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactcgcggctggcctttgtacttag

SEQ ID NO: 51809 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgcaccacgccttcagcgaccaccagtggctggacgacgccgtgggcatcgtcttccactccttcctcctcgtcccttacttctcctggaagtacagtcatcgacgccgccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51810 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatagcccacgagtgcaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51811 - DNA, 360 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcgagtggtacggcaagtacctcaacaaccctttgggacgcaccgtgatgttaacggttcagttcactctcggctggcctttgtacttag

SEQ ID NO: 51812 - DNA, 360 bp, Artificial
  Mutation in BnaA.FAD2.a introduced by TALE nuclease pair BnFAD2_T07
cctctcctccctcaccctctcccttacctcgcctggaccctctactgggcctgccaaggctgcgtcctaacgggcctctgggtcatcgcccacgaatgcgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51813 - DNA, 451 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacggtccagcggctgttgccggtgctgtgccaggcccacggcttgaccccggagcaggtggtggccatcgccagccacgatggcggcaagcaggcgctggagacggtccagcggctgttgccccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51814 - DNA, 327 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccacgccttcagcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51815 - DNA, 347 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgcgtcctaacaccacgccttcagcgaccaccagtggctggacgacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51816 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51817 - DNA, 361 bp, Artificial
  Mutation in BnaA.FAD2.a introduced by TALE nuclease pair BnFAD2_T07
cctctcctccctaccctctcccttacctcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51818 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaacctttgggacgcaccgtgatgttaacggttcagttcactctcggctggcctttgtacttag

SEQ ID NO: 51819 - DNA, 358 bp, Artificial
  Mutation in BnaA.FAD2.a introduced by TALE nuclease pair BnFAD2_T07
cctctcctccctcaccctctctcctacttcgcctggactctctactgggcctgccagggctgcgtcctaaccggcgtctgggtcatagcccacgagtgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 51820 - DNA, 356 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatcgcccacgaatgaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtactgag

SEQ ID NO: 51821 - DNA, 365 bp, Artificial
  Mutation in BnaA.FAD2.a introduced by TALE nuclease pair BnFAD2_T07
cctctcctccctcaccctctctcctacttcgcctggcctctctactgggcctgccagggatgcgtcctaaccggcgtctgggtcatagcccacgagtgcggtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 51822 - DNA, 357 bp, Artificial
  Mutation in BnaA.FAD2.a introduced by TALE nuclease pair BnFAD2_T07
cctctcctccctcaccctatcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcgccgtgatattaacggttcagttcactctcggctggcctttgtacttag

SEQ ID NO: 51823 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51824 - DNA, 349 bp, Artificial
  Mutation in BnaA.FAD2.a introduced by TALE nuclease pair BnFAD2_T07
cctctcctccctcaccctctaccttacctcgcctggcccatctactgggcctgccaaggctgcgtcctaacgggcgtctgggtaatcgcccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtgcctctacaaccctttgggacgcaccgtgatgttaacggttcagttcactctcggctggcctttgtacttag

SEQ ID NO: 51825 - DNA, 386 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatcgcccacgaatgcgatcgagatcgcccggaacagcacccaccaccacgccttcagcgaccaccagtggcgggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtggtgttaacggttcagttcactctcggctggcctttgtacttag

SEQ ID NO: 51826 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttaa

SEQ ID NO: 51827 - DNA, 359 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttg

SEQ ID NO: 51828 - DNA, 265 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaaccggcgtctgggtcatagcccacgagtgcagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51829 - DNA, 355 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51830 - DNA, 362 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcggcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51831 - DNA, 417 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgttgccggtgctgtgccaggcccgcggctgttgccggtgctgtgccaggcccacggcttgacaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51832 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51833 - DNA, 352 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgtgcctctgggtcatagcccacgagcacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaataagaagtcagacatcaagtggtacggcaagtacctcaacaaccctttgggacgcaccgtgatgttaacggttcagttcactctcggctggcttttgtacttag

SEQ ID NO: 51834 - DNA, 357 bp, Artificial
  Mutation in BnaA.FAD2.a introduced by TALE nuclease pair BnFAD2_T07
cctctcctccctcaccctctctcctacttcgcctggcctatctactgggcctgccagggctgcgtcctaaccggcgtctgggtcatagcccacgagtgcaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 51835 - DNA, 358 bp, Artificial
  Mutation in BnaA.FAD2.a introduced by TALE nuclease pair BnFAD2_T07
cctctcctccctcaccctctcccttacctcgcctggaccctctactgggcctgccaaggctgcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtaccgcaacaaccctgtgggacgcaccgtgatgttaacggttcatttcgctctcggctggcctttgtacttag

SEQ ID NO: 51836 - DNA, 365 bp, Artificial
  Mutation in BnaA.FAD2.a introduced by TALE nuclease pair BnFAD2_T07
cctctcctccctcaccctctctcctacttcgcctggcctctctactgggcctgccagggctgtgtcctaaccggcgtctgggtcatagcccacgagtgcggtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51837 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 51838 - DNA, 331 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51839 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggccaaccacgccttcagcgactaccagtggctggacgacaccgtcggcctcatcttccactccttcctccttgtcccttacttctcctggaagtacagtcatcgacgccaccattccaacactggctccctcgagagagacgaagtgtttgtccccaagaagaagtcagacatcaagtggtacggcaagtacctcaacaacccttggggacgcaccgtgatgttaacggttcagttcactctcggctggcctttgtacttag

SEQ ID NO: 51840 - DNA, 359 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatcgcccacgaatgcgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51841 - DNA, 265 bp, Artificial
  Mutation in BnaA.FAD2.a introduced by TALE nuclease pair BnFAD2_T07
cctctcctccctcaccctctcccttacctcgcctggcccctcaactgggcctgccaaggctgcgtcctaacgggcctctgggtcatagcccacgagtgcagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51842 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaccacgccttcagcgaccaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51843 - DNA, 378 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaggagtagggaactgccagccaccacgccttcagcgactaccagtggcttgacgacaccgtcggtctcatcttccactccttcctcctcgtcccttacttctcctggaagtacagccatcgacgccaccattccaacaccgaatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 51844 - DNA, 345 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgattcagcgactaccagtggctggacgacaccgtcggcctcatcttccactccttcctcctcgtcccttacttctcctggaagtacagtcatcgacgccaccattccaacactggctccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51845 - DNA, 364 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcggcggccaccacgccttcagcgaccaccagtggctggacgacgccgtgggcctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51846 - DNA, 393 bp, Artificial
  Mutation in BnaA.FAD2.a introduced by TALE nuclease pair BnFAD2_T07
cctctcctccctcaccctctgccttacctcgcctggccactctaatgggcctgccaaggctgcgtcctaacgggcctctgggtcatcgcccacgaatgcagcgcctgcttgccaccattattgctggcgatggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggcctttgtacttag

SEQ ID NO: 51847 - DNA, 358 bp, Artificial; identical to SEQ ID NO: 46315
  Mutation in BnaA.FAD2.a introduced by TALE nuclease pair BnFAD2_T07

SEQ ID NO: 51848 - DNA, 359 bp, Artificial; identical to SEQ ID NO: 47601
  Mutation in BnaA.FAD2.a introduced by TALE nuclease pair BnFAD2_T07

SEQ ID NO: 51849 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaaccctttgggacgcaccgtgatgttaacggttcagttcactctcggctggcctttgtacttag

SEQ ID NO: 51850 - DNA, 365 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgtggccggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51851 - DNA, 351 bp, Artificial
  Mutation in BnaA.FAD2.a introduced by TALE nuclease pair BnFAD2_T07
cctctactccctcaccctctctcctacttcgcctggcctctctactgggcctgccagggctgcgtcctaaccggcgtctgggtcatagcccaccgtcggccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51852 - DNA, 342 bp, Artificial
  Mutation in BnaA.FAD2.a introduced by TALE nuclease pair BnFAD2_T07
cctctcctccctcaccctctctcctacttcgcctggcctctctattgggcctgccagggctgcgtcctaaccggcgtcctaaccaccacgccttcagcgactaccagtggctggaccacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51853 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccacgccttcagcgactaccagtggcttgacgacaccgtcggtctcatcttccactccttcctcctcgtcccttacttctcctggaagtacggtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51854 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggctggacgacaccgtcggcctcatcttccactccttcctcctcgtcccttacttctcctggaagtacagtcatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51855 - DNA, 358 bp, Artificial
  Mutation in BnaA.FAD2.a introduced by TALE nuclease pair BnFAD2_T07
cctctcctccctcaccctctgccttaccccgcctggcccctctactgggcctgccaaggctgcgtcctaacgggcctctgggtcatcgcccacgaatgctaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacatccgtttgggacgcaccgtgatgtaaacggttcagttcacgctcggctggccttagtacttag

SEQ ID NO: 51856 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51857 - DNA, 357 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagtcatctacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51858 - DNA, 350 bp, Artificial
  Mutation in BnaA.FAD2.a introduced by TALE nuclease pair BnFAD2_T07
cctctcctccctcaccctctcccttacctcgcctggtccctctactgggcctgccaaggctgcgtcctaaccggcgtctgggtcatagcccaaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacgtag

SEQ ID NO: 51859 - DNA, 403 bp, Artificial
  Mutation in BnaA.FAD2.a introduced by TALE nuclease pair BnFAD2_T07
cctctcctccctcaccctctctcctacttcgcctggactctctactgggcctgccagggctgcgtcctaaccggcgtctgggtcatagcccaccagcaatattggtggcaagcaggcgctggagacggtgcaggcgctgttgcccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccccttgggacgcaccgtgatgttaacggttcagttcactctcggcgggcctttgtacttag

SEQ ID NO: 51860 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggccaccacgccttcagcgactaccagtggcttgacgacaccgtcggtctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51861 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgactaccagtggctggacgacaccgtcggcatcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 51862 - DNA, 364 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgtgcctaaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51863 - DNA, 345 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctggtcatagcccacgagtgcggcgactaccagtggcttgacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 51864 - DNA, 360 bp, Artificial
  Mutation in BnaA.FAD2.a introduced by TALE nuclease pair BnFAD2_T07
cctctcctcccttaccctctcccttacctcgcctggcccatctactgggcctgccaaggctgcgtcctaacgggcctctgggtcatcgcccacgaatgcgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51865 - DNA, 347 bp, Artificial
  Mutation in BnaA.FAD2.a introduced by TALE nuclease pair BnFAD2_T07
cctctcctccctcaccctctcccttacctcgcctggcccctctaatgggcctgccaaggctgcgtcctaacgggcctctgcgtcctaacaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51866 - DNA, 406 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccacgaatgctgctggcgatggccaccacctgctggggggtcacgccgtgggcctggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51867 - DNA, 355 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacggccaccacgccttcagcgactaccagtggctggacgacaccgtcggcctcatcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaacccgtggggacgcaccgtgatgttaacggttcagttcactctcggctggcctttgtacttag

SEQ ID NO: 51868 - DNA, 403 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccaccagcaatattggtggcaagcaggcgctggagacggtgcaggcgctgttgcccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51869 - DNA, 347 bp, Artificial
  Mutation in BnaA.FAD2.a introduced by TALE nuclease pair BnFAD2_T07
ctctcctccctcaccctcttccttacctcgcctggcccctctactgggcctgccaaggctgcgtcctaacgggcctctgggtcatcgctaccacgacttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactcgcggctggccttagtacttag

SEQ ID NO: 51870 - DNA, 353 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51871 - DNA, 462 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccacgaatgcgccgccatcgtggctggcgatggccaccacctgctccggggtcaagccgtgggcctggcacagcaccggcaacagccgctggaccgtctccagcgcctgcttgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51872 - DNA, 350 bp, Artificial
  Mutation in BnaA.FAD2.a introduced by TALE nuclease pair BnFAD2_T07
cctctcctccctcaccctctcccttacctcgcctggcctctctactgggcctgccaagggtgcgtcctaaccggcgtctgggtcatagcccaaccacgccttcagcgactaccagtggctggacgacgccgtgggcctcgtcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgaggttaacggttcagttcactctcggctggcctttgtacttag

SEQ ID NO: 51873 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgaccacgccttcagcgaccaccagtggctggacgacgccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctcggctggcctttgtacttag

SEQ ID NO: 51874 - DNA, 282 bp, Artificial
  Mutation in BnaA.FAD2.a introduced by TALE nuclease pair BnFAD2_T07
cctctcctccctcaccctctctccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcacgctcggctggcctttgtacttag

SEQ ID NO: 51875 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagccctttgggacgcaccgtgatgttaacggttcagttcactctcggctggcctttgtacttag

SEQ ID NO: 51876 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcaacgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51877 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcatcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51878 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtcggcctcatcttccactccttcctcctcgtcccttacttctcctggaagtacagtcatcgacgccaccattccaacactggctccctcgagagagacgaagggtttgtccccaagaagaagtcagacatcaagtggtacggcaagtacctcaacaaccctttgggacgcaccgtgatgttaacggttcagttcactctcggctggcctttgtacttag

SEQ ID NO: 51879 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51880 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcaccacgccttcagcgactaccagtggcttgacgacaccgtcggtctcatcttccactccttcctcctcgtcccttacttctcctggaagtacagtcatcgacgccaccattccaacactggctccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51881 - DNA, 349 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51882 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgaccacgccttcagcgactaccagtggcttgacaacaccgtcggtctcatcttcccctccttcctcctcgtcccttacttctcctggaagtacagtcatcgacgccaccattccaacactggctccctcgagagagacgaagtgtttgtccccaagaagaagtcagacatcaagtggtacggcaagtacctcaacacccctttgggacgcaccgtgatgttaacggttcaggtcactctcggctggcctttgtacttag

SEQ ID NO: 51883 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatcgcccacgaatgcgggccaccacgccttcagcgacaaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51884 - DNA, 363 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccacgagtgcgggcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcactgtgatgttaacggttcagttcacgcccggctggccttagtacttag

SEQ ID NO: 51885 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactacctgtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51886 - DNA, 425 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccagcggcggaggaactctttgatccggttcctgaacaccgtgggctcccccatcgactacggcgtaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51887 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggcccaccacgccttcagcgactaccagtggctggacgacaccgtgggcctcgtcttccactccttcctcctcgtcccttacttctcctggaagtacagtcatcgacgccaccattccaacactggctccctcgagagagacgaagtgtttgtccccaagaagaagtccgacatcaagtggtacggaaagtacctcaacaacccgctaggacgcacggtgatgctaaccgtccagttcacgctcggctggcctttgtacttag

SEQ ID NO: 51888 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgagacgcaccgtgatgttaacggttcagttcactctcggctggcctttgtacttag

SEQ ID NO: 51889 - DNA, 421 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggccaccaccaataatggtggcaagcaggcgctggagacggtccagcggctgttgccggtgccaccacgccttcagcgaccaccagtggctggacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51890 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcctctgggtcatcgcccacgaatgctaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51891 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51892 - DNA, 342 bp, Artificial
  Mutation in BnaA.FAD2.a introduced by TALE nuclease pair BnFAD2_T07
cctctcctccctcaccctctctcctacttcgcctggcccctctattgggcctgccagggctgcgtcctaaccggcgtcctaaccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51893 - DNA, 358 bp, Artificial
  Mutation in BnaA.FAD2.a introduced by TALE nuclease pair BnFAD2_T07
cctctcctccctcaccctctcacttacctcgcctggcccctctactgggcctgccagggctgcgtcctaaccggcgtctgggtcatagcccacgagtgcgaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaacccgctaggacgcacggtgatgctaaccgtccagttcacgctcggctggcctttgtacttag

SEQ ID NO: 51894 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatcgcccacgaatgcgatgaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51895 - DNA, 343 bp, Artificial
  Mutation in BnaA.FAD2.a introduced by TALE nuclease pair BnFAD2_T07
cctctcctccctcaccctgtcccttacctcgcctggcccctctactgggcctgccaaggctgcgtcctaacgggcctctgggtcatcgcccacgaatgcgatgaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51896 - DNA, 345 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggccttggtattag

SEQ ID NO: 51897 - DNA, 325 bp, Artificial
  Mutation in BnaA.FAD2.a introduced by TALE nuclease pair BnFAD2_T07
cctctcctccctcaccctctctcctacttcgcctggcctctctactgggcctgccagggctgcgtctaccacgccttcagcgactaccagtggctggacgacaccgtcggcctcatcttccactccttcctcctcgtcccttacttctccttgaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51898 - DNA, 359 bp, Artificial
  Mutation in BnaA.FAD2.a introduced by TALE nuclease pair BnFAD2_T07
cctctcctccctcaccctttctcctacttcgcctggcctctctactgggcctgccagggctgcgtcctaaccggcgtctgggtcatagcccacgagtgcggaccacgccttcagcgactaccagtggctggacgacaccgtcggcctcatcttccactccttcctcctcgtcccttacttctcctggaagtacagtcatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 51899 - DNA, 442 bp, Artificial
  Mutation in BnaA.FAD2.a introduced by TALE nuclease pair BnFAD2_T07
cctctcctccctcaccctttctcctacttcgcctggcctctctactgggcctgccaagggtgcgtcctaaccggcgtctgggtcatagcccacgagtttggaccgtctccagcgcctgcttgccgccatcgtggctggcgatggccaccacctgctccggggtcaagccgtgggcctggcagccaccacgccttcagcgactaccagtggctggaccacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcaggtcactctcggcgggcctttgtacttag

SEQ ID NO: 51900 - DNA, 354 bp, Artificial
  Mutation in BnaA.FAD2.a introduced by TALE nuclease pair BnFAD2_T07
cctctcctccctcaccctctcccctacttcgcctggcccatctactgggcctgccaaggctgcgtcctaacgggcctctgggtcatcgcccacgaatccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctgtgggacgcaccgtgatgttaacggttcagttcactctctgctggcctttgtacttag

SEQ ID NO: 51901 - DNA, 360 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggccacacgccttcagcgactaccagtggctggacgacaccgtcggtctcatcttccactccttcctccccgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51902 - DNA, 343 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaacgggcctctgggtcatcgcccacgaatgcgatgaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51903 - DNA, 349 bp, Artificial
  Mutation in BnaA.FAD2.a introduced by TALE nuclease pair BnFAD2_T07
cctctcctccctcaccctctctcctacttcgcctggcccctctactgggcctgccaaggctgcgtcctaacgggcctctgggtcatcgcccaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 51904 - DNA, 360 bp, Artificial
  Mutation in BnaA.FAD2.a introduced by TALE nuclease pair BnFAD2_T07
cctctcctccctcaccctgtctcctacttcgcctggcctctctactgggcctgccagggctgcgtcctaaccggcgtctgggtcatagcccacgagtgcgccaccacgccttcagcgactaccagtggctagaccacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggcaagtacctcaacaaccctttgggacgcaccgtgatgttaacggttcagttcacgctcggctggcctttgtacttag

SEQ ID NO: 51905 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgtcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51906 - DNA, 362 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcctctgggtcatcgcccacgagtgcggcccaccacgccttcagcgactaccagtggctggacgacgccgtcggcctcatctccccctccttcctcctcgtcccttacttctcctggaagtacagtcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcacgctcggctggcctttgtacttag

SEQ ID NO: 51907 - DNA, 355 bp, Artificial
  Mutation in BnaA.FAD2.a introduced by TALE nuclease pair BnFAD2_T07
cctctcctccctcaccctctctcctacttcgcctggcccctctactgggcctgccaagggtgcgtcctaaccggcgtctgggtcatagcccacgagtaccacgccttcagcgaccaccagtggctggacgacgccgtcggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacggaccgtgaggttaacggttcagttcactctcggctggcctttgtacttag

SEQ ID NO: 51908 - DNA, 401 bp, Artificial
  Mutation in BnaA.FAD2.a introduced by TALE nuclease pair BnFAD2_T07
cctctcctccctcaccctctctcctacttcgcctggcctctctactgggcctggtgccaggcccacggcttgaccccggagcaggtggtggccatcgccagccacgatggcggcaagcaggcgctggagacggtccagcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51909 - DNA, 346 bp, Artificial; identical to SEQ ID NO: 47940
  Mutation in BnaA.FAD2.a introduced by TALE nuclease pair BnFAD2_T07

SEQ ID NO: 51910 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgtgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctccctcgagagagacgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 51911 - DNA, 352 bp, Artificial
  Mutation in BnaA.FAD2.a introduced by TALE nuclease pair BnFAD2_T07
cctctcctccctcaccctctctcctacttcgcctggcctatctactgggcctgccagggctgcgtcctaaccggcgtctgggtcatagcccacgagtgcgccttcagcgactaccagtggctggacgacaccgtcggcctcatcttccactccttcctcctcgtcccttacttctcctggaagtacagtcatcgacgccaccattccaacactggctccctctagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51912 - DNA, 378 bp, Artificial
  Mutation in BnaA.FAD2.a introduced by TALE nuclease pair BnFAD2_T07
cctctcctccctcaccctgtctcctacttcgcctggcctctctactgggcctgccagggctgcgtcctaaccggcgtctgggtcatagcccacgagtgcaggagtagggaactgccagccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagtgcactctcggctggcctttgtacttag

SEQ ID NO: 51913 - DNA, 412 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcggactgcaatttggagaatggcagcgcaatgacattcttgcaggtatcttcggccaccacgccttcagcgactaccagtggctggacgacaccgtcggcctcatcttccactccttcctcctcgtcccttacttctcctggaagtacagccatcgacgccaccattccaacaccggatccctcgagagggatgaagtgttcgtccccaagaagaagtcagacatcaagtggtacggcaagtacctcaacaaccctttgggacgcaccgtgatgctaaccgtccatttcacgctcggctggcctttgtacttag

SEQ ID NO: 51914 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcaaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51915 - DNA, 309 bp, Artificial
  Mutation in BnaA.FAD2.a introduced by TALE nuclease pair BnFAD2_T07
cctctcctccctcaccctctctcctacttcgcctggcctctctactgggccaccacgccttcagcgactaccagtggcttgacgacaccgtcggcctcatcttccactccttcctcctcgtaccttacttctcctggaagtacagtcatcgacgccaccattccaacactggctccctcgagagagacgaagtgtttgtccccaagaagaagtcagacatcaagtggtacggcaagtacctcaacaaccctttgggactcaccgtgatgttaacggttcatttcactctcggctggccttagtacttag

SEQ ID NO: 51916 - DNA, 403 bp, Artificial
  Mutation in BnaA.FAD2.a introduced by TALE nuclease pair BnFAD2_T07
cctctcctccctcaccctctcccttacctcgcctggcccctctactgggcctgccagggctgcgtcctaaccggcgtctgggtcatagcccaccagcaatattggtggcaagcaggcgctggagacggtgcaggcgctgttgcccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51917 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgccaccacgccttcagcgactaccagtggctggacgacaccgtcggcctcatcttccactacttcctcctcgtcccttacttctcctggaagtacagtcatcgacgccaccattccaacactggctccctcgagagagacgaagtgtttgtccccaagaagaagtcagacatcaagtggtccggcaagtacctcaacaaccctctggaacgcaccgtgatgttaacggttcagttcactctcggctggccttagtacttag

SEQ ID NO: 51918 - DNA, 352 bp, Artificial
  Mutation in BnaA.FAD2.a introduced by TALE nuclease pair BnFAD2_T07
cctctcctccctcaccctctctcttacctcgcctggcctctctactgggcctgccaaggctgcgtcctaaccggcgtctgggtcatagcccacgagcacgccttcagcgactaccagtggctggacgacaccgtcggcctcatcttccactccttcctcctcgtcccttacttctcctggaagtacagccatcgacgccaccattccaacaccggatccctcgagagagacgaagtgtttgtccccaagaagaaatccgacatcaagtggtacggaaagtacctcaacaaccctttaggacgcacggtgatgctaaccgtccagttcactctcggctggcctttgtacttag

SEQ ID NO: 51919 - DNA, 357 bp, Artificial
  Mutation in BnaA.FAD2.a introduced by TALE nuclease pair BnFAD2_T07
cctctcctccctcacctctctcctacttcgcctggcctctctactgggcctgccaagggtgcgtcctaaccggcgtctgggtcatagcccacgagtgccaccacgccttcagcgactaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51920 - DNA, 349 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacggacctctgggtcatcgcccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtgcctcaacaaccctttgtgactcaccgtgatgttaacggttcagttcactctcggctggcctttgtacttag

SEQ ID NO: 51921 - DNA, 346 bp, Artificial
  Mutation in BnaA.FAD2.a introduced by TALE nuclease pair BnFAD2_T07
cctctcctccctcaccctctctcctacttcgcctggcctctctactgggcctgccaaggctgcgtcctaacgggcctctgggtcacccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51922 - DNA, 359 bp, Artificial; identical to SEQ ID NO: 47258
  Mutation in BnaA.FAD2.a introduced by TALE nuclease pair BnFAD2_T07

SEQ ID NO: 51923 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagtcatcgacgccaccataccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51924 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgggatgttaacggttcagttcactctcggctggcctttgtacttag

SEQ ID NO: 51925 - DNA, 357 bp, Artificial
  Mutation in BnaA.FAD2.a introduced by TALE nuclease pair BnFAD2_T07
cctctcctccctcaccctatctcctacttcgcctggcctctctactgggcctgccagggctgcgtcctaacgggcctctgggtcatcgcccacgaatgcaccacgccttcagcgaccaccagtggctggacgacgccgtgggcctcgtcttccactccttcctcctcgtcccttacttctcctggaagtacagccatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 51926 - DNA, 358 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcataaccggcgtctgggtcatagcccacgagtgccaccacgccttcagcgactaccagtggcttgacgacaccgtcggtctcgtcttccactccttcctcctcgtcccttacttctcctggaagtacagccatcgacgccaccattccaacaccggatccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51927 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcgggccaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcagtctcggctggcctttgtacttag

SEQ ID NO: 51928 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggcttcgtcctaacgggcctctgggtcatcgcccacgaatgcgaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51929 - DNA, 433 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcgggggagaggcggtttgcgtattgggggctcttccgctttctcgctccctgactctcttcgctccggcggtcggcccccacgccctcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51930 - DNA, 358 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgccaccacgccttcagcgaccaccagtggctggacgacgccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggcaagtacctcaacaaccctttgggacgcaccgtgatgttaacggttcagttcacgctcggctggcctttgtacttag

SEQ ID NO: 51931 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgagtgcaccacgccttcagcgactaccagtggcttgacgacaccgtcggtctcatcttccactccttcctcctcgtcccttacttctcctggaagtacagtcatcgacgccaccattccaacactggctcccccgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51932 - DNA, 357 bp, Artificial
  Mutation in BnaA.FAD2.a introduced by TALE nuclease pair BnFAD2_T07
cctctcctccctcaccctctcccttacctcgcctggcctctctactgggcctgccagggctgcgtcctaaccggcgtctgggtcatagcccacgaatgcaccacgccttcagcgaccaccagtggctggacgacgccgtgggcctcgtcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51933 - DNA, 355 bp, Artificial
  Mutation in BnaA.FAD2.a introduced by TALE nuclease pair BnFAD2_T07
cctctcctccctcaccctttctcctacttcgcctggcctctctactgggcctgccagggctgcgtcctaaccggcgtctgggtcatagcccacgagtaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51934 - DNA, 345 bp, Artificial
  Mutation in BnaA.FAD2.a introduced by TALE nuclease pair BnFAD2_T07
cctctcctccctcaccctctctcctacttcgcctggcctctctactgggcctgccagggctgcgtcctaaccggcgtctgggtcatagcccacgattcagcgactaccagtggctggacgacaccgtcggcctcatcttccactccttcctcctcgtcccttacttctcctggaagtacagtcatcgacgccaccattccaacactggctccctcgagagagacgaagtgtgtgtccccaagaagaaatccgacatcaagtggtacggaaagtacctcaacaacccgctaggacgcacggtgatgctaaccgtccagttcacgctcggctggcctttgtacttag

SEQ ID NO: 51935 - DNA, 362 bp, Artificial
  Mutation in BnaA.FAD2.a introduced by TALE nuclease pair BnFAD2_T07
cctctcctccctcaccctctcccttacctcgcctggcccctctactgggcctgccaaggctgcgtcctaacgggcctctgggtcatcgcccacgaatgcggctcaccacgccttcagcgaccaccagtggctggacgacgccgtgggcctcgtcttccactccttcctcctcgtcccttacttctcctggaagtacagccatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttag

SEQ ID NO: 51936 - DNA, 358 bp, Artificial
  Mutation in BnaA.FAD2.a introduced by TALE nuclease pair BnFAD2_T07
cctctcctccctcacccgctcacctacttcgcctggcctctctactgggcctgccagggctgcgtcctaaccggcgtctgggtcatagcccacgagtgccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaaatccgacatcaagtggtacggaaagtacctcaacaacccgctaggacgcacggtgatgctaaccgtccagttcacgctcggctggcctttgtacttag

SEQ ID NO: 51937 - DNA, 382 bp, Artificial
  Mutation in BnaA.FAD2.a introduced by TALE nuclease pair BnFAD2_T07
cctctcctccctcaccctctctcctacttcgcctggcccctctactgggcctgccaagggtgcgtcctaaccggcgtctgggtcatagcccacgagtgcggcggtggcaagcagtcgctggaccaccccgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacagcccgttgggacgcaccgtgaggttaacggttcagttcactctcggctggcctttgtacttag

SEQ ID NO: 51938 - DNA, 357 bp, Artificial
  Mutation in BnaA.FAD2.a introduced by TALE nuclease pair BnFAD2_T07
cctctcctccctcaccctctctcctacttcgcctggcctctctactgggcctgccaagggtgcgtcctaaccggcgtctgggtcatagcccacgagtgccaccacgcctcagcgactaccagtggctggacgacaccgtcggcctcatcttccactccttcctcctcgtcccttacttctcctggaagtacagccatcgacgccaccattccaacaccggatccctcgagagggatgaagtgtttgtccccaagaagaagtcagacatcaagtggtacggaaagtacctcaacaacccgctaggacgcacggtgatgctaaccgtccagttcacgctcggctggcctttgtacttag

SEQ ID NO: 51939 - DNA, 359 bp, Artificial; identical to SEQ ID NO: 46209
  Mutation in BnaA.FAD2.a introduced by TALE nuclease pair BnFAD2_T07
